US007122373B1

(12) United States Patent
Williams et al.

(10) Patent No.: US 7,122,373 B1
(45) Date of Patent: Oct. 17, 2006

(54) HUMAN GENES AND GENE EXPRESSION PRODUCTS V

(75) Inventors: Lewis T. Williams, Tiburon, CA (US); Jaime Escobedo, Alamo, CA (US); Michael A. Innis, Moraga, CA (US); Pablo Dominguez Garcia, San Francisco, CA (US); Julie Sudduth-Klinger, Kensington, CA (US); Christoph Reinhard, Alameda, CA (US); Klaus Giese, Berlin (DE); Filippo Randazzo, San Francisco, CA (US); Giulia C. Kennedy, San Francisco, CA (US); David Pot, San Francisco, CA (US); Altaf Kassam, Oakland, CA (US); George Lamson, Moraga, CA (US); Radoje Drmanac, Palo Alto, CA (US); Radomir Crkvenjakov, Sunnyvale, CA (US); Mark Dickson, Hollister, CA (US); Snezana Drmanac, Palo Alto, CA (US); Ivan Labat, Sunnyvale, CA (US); Dena Leshkowitz, Sunnyvale, CA (US); David Kita, Foster City, CA (US); Veronica Garcia, Sunnyvale, CA (US); Lee William Jones, Sunnyvale, CA (US); Birgit Stache-Crain, Sunnyvale, CA (US)

(73) Assignee: Nuvelo, Inc., Sunnyvale, CA (US)

(*) Notice: Subject to any disclaimer, the term of this patent is extended or adjusted under 35 U.S.C. 154(b) by 809 days.

(21) Appl. No.: 09/313,292

(22) Filed: May 13, 1999

Related U.S. Application Data

(60) Provisional application No. 60/105,877, filed on Oct. 27, 1998, provisional application No. 60/105,234, filed on Oct. 21, 1998, provisional application No. 60/085,696, filed on May 15, 1998, provisional application No. 60/085,537, filed on May 15, 1998, provisional application No. 60/085,426, filed on May 14, 1998.

(51) Int. Cl.
*C12N 5/10* (2006.01)
*C12N 15/63* (2006.01)
*C12N 15/11* (2006.01)

(52) U.S. Cl. .................. 435/325; 435/320.1; 536/23.5

(58) Field of Classification Search ............... 435/69.1, 435/320.1; 536/23.5
See application file for complete search history.

(56) References Cited

OTHER PUBLICATIONS

Genbank Accession No. U58766 Nov. 1, 1996.*
Genbank Accession No. AA544005 Aug. 1, 1997.*
Genbank Accession No. M15796 Apr. 27, 1993.*
Genbank Accession No. M88458 Apr. 27, 1993.*
Genbank Accession No. AA068559 Feb. 6, 1997.*
Genbank Accession No. AA131908 May 14, 1997.*
Genbank Accession No. AA050390 Sep. 9, 1996.*
Genbank Accession No. W89528 Sep. 12, 1996.*
Genbank Accession No. H93085 Nov. 30, 1995.*
Genbank Accession No. S82472 Dec. 3, 1996.*
Yang et al Protein-peptide interactions analyzed with the yeast two-hybrid system Nucleic Acids Research 1995. vol. 23. No. 7. pp. 1152-1156.*
Clarke et al. Progression of human breast cancer cells from hormone-dependent to hormone-independent growth both in vitro and in vivo. Proc. Natl. Acad. Sci. USA vol. 86, pp. 3649-3653 (1989).*
Chandrasekaran et al. Glycosoaminoglycans of normal and malignant cultured human mammary cells. Cancer Research vol. 39, pp. 870-877 (1979).*
Brinkley et al. Variations in cell form and cytoskeleton in human breast carcinoma cells in vitro. Cancer Research vol. 40, pp. 3118-3129 (1980).*
Odum et al. Limitations of the MCF-7 Cell Proliferation Assay for Detecting Xenobiotic Oestrogens. Toxicology in Vitro vol. 12, pp. 273-278 (1998).*
Chabert et al. Cell culture of tumors alters endogenous poly(ADPR) polymerase expression and activity. Int. J. Cancer vol. 53 837-842 (1993).*
Dermer Another Anniversary for the War on Cancer. Bio/Technology vol. 12, p. 320 (1994).*
Carmeci et al. (Nov. 1997), "Identification of a Gene (GPR30) with Homology to the G-Protein-Coupled Receptor Superfamily Associated with Estrogen Receptor Expression in Breast Cancer," *Genomics*, vol. 45(3):607-617.
Morissey, J.H. (Feb. 20, 1989), "Human Tissue Factor Gene," *EMBL Databank*, ID HSTFPB.
Yeatman et al. (1995), "identification of a Differentially -Expressed Message Associated with Colon Cancer Liver Metastasis Using an Improved Method of Differential Display," *Nucleic Acids Research*, vol. 23(19):4007-4008.
Yeatman et al. (May 1996), "Identification of Genetic Alterations Associated with the Process of Human Experimental Colon Cancer Liver Metastasis in the Nude Mouse," *Clinical and Experimental Metastasis*, vol. 14(3):1996-2005.
Genbank Accession No. AF273437, deposited Aug. 17, 2000.
Genbank Accession No. AJ278133, deposited Mar. 19, 2001.
Genbank Accession No. AK001197, deposited Feb. 22, 2000.
Genbank Accession No. AK001402, deposited Feb. 22, 2000.

(Continued)

*Primary Examiner*—John S. Brusca
(74) *Attorney, Agent, or Firm*—Fish & Richardson P.C.

(57) ABSTRACT

This invention relates to novel human polynucleotides and variants thereof, their encoded polypeptides and variants thereof, to genes corresponding to these polynucleotides and to proteins expressed by the genes. The invention also relates to diagnostic and therapeutic agents employing such novel human polynucleotides, their corresponding genes or gene products, e.g., these genes and proteins, including probes, antisense constructs, and antibodies.

8 Claims, No Drawings

OTHER PUBLICATIONS

Genbank Accession No. AK001468, deposited Feb. 22, 2000.
Genbank Accession No. AK001472, deposited Feb. 22, 2000.
Genbank Accession No. AK003515, deposited Feb. 8, 2001.
Genbank Accession No. AK005163, deposited Feb. 8, 2001.
Genbank Accession No. AK007403, deposited Feb. 8, 2001.
Genbank Accession No. AK007686, deposited Feb. 8, 2001.
Genbank Accession No. AL117496, deposited Mar. 10, 2001.
Genbank Accession No. NM_006854, deposited Nov. 2, 2000.
Genbank Accession No. NM_016195, deposited Nov. 2, 2000.
Genbank Accession No. NM_018062, deposited Nov. 2, 2000.
Genbank Accession No. NM_018131, deposited Nov. 2, 2000.
Genbank Accession No. NM_025841, deposited Mar. 20, 2001.
Genbank Accession No. X63745, deposited Jul. 12, 1996.
Genbank Accession No. XM_002688, deposited Apr. 16, 2001.
Genbank Accession No. XM_004631, deposited Apr. 16, 2001.
Genbank Accession No. XM_004854, deposited Apr. 16, 2001.
Genbank Accession No. XM_005803, deposited Apr. 16, 2001.
Genbank Accession No. XM_005908, deposited Apr. 16, 2001.
Genbank Accession No. A42286, deposited Aug. 13, 1999.
Genbank Accession No. M88458, deposited Apr. 27, 1993.
Genbank Accession No. NM_002592, deposited Oct. 31, 2000.
Genbank Accession No. 2914385, deposited Oct. 14, 1997.

* cited by examiner

HUMAN GENES AND GENE EXPRESSION PRODUCTS V

CROSS-REFERENCE TO RELATED APPLICATIONS

This application claims the benefit of U.S. provisional patent application Ser. No. 60/085,426, filed May 14, 1998; and of U.S. provisional patent application Ser. No. 60/085,537, filed May 15, 1998; and of U.S. provisional patent application Ser. No. 60/085,696, filed May 15, 1998; and of U.S. provisional patent application Ser. No. 60/105,234, filed Oct. 21, 1998; and of U.S. provisional patent application Ser. No. 60/105,877 filed Oct. 27, 1998; each of which applications are incorporated herein by reference.

FIELD OF THE INVENTION

The present invention relates to polynucleotides of human origin and the encoded gene products.

BACKGROUND OF THE INVENTION

Identification of novel polynucleotides, particularly those that encode an expressed gene product, is important in the advancement of drug discovery, diagnostic technologies, and the understanding of the progression and nature of complex diseases such as cancer. Identification of genes expressed in different cell types isolated from sources that differ in disease state or stage, developmental stage, exposure to various environmental factors, the tissue of origin, the species from which the tissue was isolated, and the like is key to identifying the genetic factors that are responsible for the phenotypes associated with these various differences.

This invention provides novel human polynucleotides, the polypeptides encoded by these polynucleotides, and the genes and proteins corresponding to these novel polynucleotides.

SUMMARY OF THE INVENTION

This invention relates to novel human polynucleotides and variants thereof, their encoded polypeptides and variants thereof, to genes corresponding to these polynucleotides and to proteins expressed by the genes. The invention also relates to diagnostics and therapeutics comprising such novel human polynucleotides, their corresponding genes or gene products, including probes, antisense nucleotides, and antibodies. The polynucleotides of the invention correspond to a polynucleotide comprising the sequence information of at least one of SEQ ID NOS:1–2707.

Various aspects and embodiments of the invention will be readily apparent to the ordinarily skilled artisan upon reading the description provided herein.

DETAILED DESCRIPTION OF THE INVENTION

The invention relates to polynucleotides comprising the disclosed nucleotide sequences, to full length cDNA, mRNA genomic sequences, and genes corresponding to these sequences and degenerate variants thereof, and to polypeptides encoded by the polynucleotides of the invention and polypeptide variants. The following detailed description describes the polynucleotide compositions encompassed by the invention, methods for obtaining cDNA or genomic DNA encoding a full-length gene product, expression of these polynucleotides and genes, identification of structural motifs of the polynucleotides and genes, identification of the function of a gene product encoded by a gene corresponding to a polynucleotide of the invention, use of the provided polynucleotides as probes and in mapping and in tissue profiling, use of the corresponding polypeptides and other gene products to raise antibodies, and use of the polynucleotides and their encoded gene products for therapeutic and diagnostic purposes.

Polynucleotide Compositions

The scope of the invention with respect to polynucleotide compositions includes, but is not necessarily limited to, polynucleotides having a sequence set forth in any one of SEQ ID NOS:1–2707; polynucleotides obtained from the biological materials described herein or other biological sources (particularly human sources) by hybridization under stringent conditions (particularly conditions of high stringency); genes corresponding to the provided polynucleotides; variants of the provided polynucleotides and their corresponding genes, particularly those variants that retain a biological activity of the encoded gene product (e.g., a biological activity ascribed to a gene product corresponding to the provided polynucleotides as a result of the assignment of the gene product to a protein family(ies) and/or identification of a functional domain present in the gene product). Other nucleic acid compositions contemplated by and within the scope of the present invention will be readily apparent to one of ordinary skill in the art when provided with the disclosure here. "Polynucleotide" and "nucleic acid" as used herein with reference to nucleic acids of the composition is not intended to be limiting as to the length or structure of the nucleic acid unless specifically indicted.

The invention features polynucleotides that are expressed in human tissue, specifically human colon, breast, and/or lung tissue. Novel nucleic acid compositions of the invention of particular interest comprise a sequence set forth in any one of SEQ ID NOS:1–2707 or an identifying sequence thereof. An "identifying sequence" is a contiguous sequence of residues at least about 10 nt to about 20 nt in length, usually at least about 50 nt to about 100 nt in length, that uniquely identifies a polynucleotide sequence, e.g., exhibits less than 90%, usually less than about 80% to about 85% sequence identity to any contiguous nucleotide sequence of more than about 20 nt. Thus, the subject novel nucleic acid compositions include full length cDNAs or mRNAs that encompass an identifying sequence of contiguous nucleotides from any one of SEQ ID NOS: 1–2707.

The polynucleotides of the invention also include polynucleotides having sequence similarity or sequence identity. Nucleic acids having sequence similarity are detected by hybridization under low stringency conditions, for example, at 50° C. and 10×SSC (0.9 M saline/0.09 M sodium citrate) and remain bound when subjected to washing at 55° C. in 1×SSC. Sequence identity can be determined by hybridization under stringent conditions, for example, at 50° C. or higher and 0.1×SSC (9 mM saline/0.9 mM sodium citrate). Hybridization methods and conditions are well known in the art, see, e.g., U.S. Pat. No. 5,707,829. Nucleic acids that are substantially identical to the provided polynucleotide sequences, e.g. allelic variants, genetically altered versions of the gene, etc., bind to the provided polynucleotide sequences (SEQ ID NOS:1–2707) under stringent hybridization conditions. By using probes, particularly labeled probes of DNA sequences, one can isolate homologous or related genes. The source of homologous genes can be any species, e.g. primate species, particularly human; rodents, such as rats and mice; canines, felines, bovines, ovines, equines, yeast, nematodes, etc.

Preferably, hybridization is performed using at least 15 contiguous nucleotides (nt) of at least one of SEQ ID NOS:1–2707. That is, when at least 15 contiguous nt of one of the disclosed SEQ ID NOS. is used as a probe, the probe will preferentially hybridize with a nucleic acid comprising the complementary sequence, allowing the identification and retrieval of the nucleic acids that uniquely hybridize to the selected probe. Probes from more than one SEQ ID NO. can hybridize with the same nucleic acid if the cDNA from which they were derived corresponds to one mRNA. Probes of more than 15 nt can be used, e.g., probes of from about 18 nt to about 100 nt, but 15 nt represents sufficient sequence for unique identification.

The polynucleotides of the invention also include naturally occurring variants of the nucleotide sequences (e.g., degenerate variants, allelic variants, etc.). Variants of the polynucleotides of the invention are identified by hybridization of putative variants with nucleotide sequences disclosed herein, preferably by hybridization under stringent conditions. For example, by using appropriate wash conditions, variants of the polynucleotides of the invention can be identified where the allelic variant exhibits at most about 25–30% base pair (bp) mismatches relative to the selected polynucleotide probe. In general, allelic variants contain 15–25% bp mismatches, and can contain as little as even 5–15%, or 2–5%, or 1–2% bp mismatches, as well as a single bp mismatch.

The invention also encompasses homologs corresponding to the polynucleotides of SEQ ID NOS:1–2707, where the source of homologous genes can be any mammalian species, e.g., primate species, particularly human; rodents, such as rats; canines, felines, bovines, ovines, equines, yeast, nematodes, etc. Between mammalian species, e.g., human and mouse, homologs generally have substantial sequence similarity, e.g., at least 75% sequence identity, usually at least 90%, more usually at least 95% between nucleotide sequences. Sequence similarity is calculated based on a reference sequence, which may be a subset of a larger sequence, such as a conserved motif, coding region, flanking region, etc. A reference sequence will usually be at least about 18 contiguous nt long, more usually at least about 30 nt long, and may extend to the complete sequence that is being compared. Algorithms for sequence analysis are known in the art, such as gapped BLAST, described in Altschul, et al. *Nucleic Acids Res.* (1997) 25:3389–3402.

In general, variants of the invention have a sequence identity greater than at least about 65%, preferably at least about 75%, more preferably at least about 85%, and can be greater than at least about 90% or more as determined by the Smith-Waterman homology search algorithm as implemented in MPSRCH program (Oxford Molecular). For the purposes of this invention, a preferred method of calculating percent identity is the Smith-Waterman algorithm, using the following. Global DNA sequence identity must be greater than 65% as determined by the Smith-Waterman homology search algorithm as implemented in MPSRCH program (Oxford Molecular) using an affine gap search with the following search parameters: gap open penalty, 12; and gap extension penalty, 1.

The subject nucleic acids can be cDNAs or genomic DNAs, as well as fragments thereof, particularly fragments that encode a biologically active gene product and/or are useful in the methods disclosed herein (e.g., in diagnosis, as a unique identifier of a differentially expressed gene of interest, etc.). The term "cDNA" as used herein is intended to include all nucleic acids that share the arrangement of sequence elements found in native mature mRNA species, where sequence elements are exons and 3' and 5' non-coding regions. Normally mRNA species have contiguous exons, with the intervening introns, when present, being removed by nuclear RNA splicing, to create a continuous open reading frame encoding a polypeptide of the invention.

A genomic sequence of interest comprises the nucleic acid present between the initiation codon and the stop codon, as defined in the listed sequences, including all of the introns that are normally present in a native chromosome. It can further include the 3' and 5' untranslated regions found in the mature mRNA. It can further include specific transcriptional and translational regulatory sequences, such as promoters, enhancers, etc., including about 1 kb, but possibly more, of flanking genomic DNA at either the 5' and 3' end of the transcribed region. The genomic DNA can be isolated as a fragment of 100 kbp or smaller; and substantially free of flanking chromosomal sequence. The genomic DNA flanking the coding region, either 3' and 5', or internal regulatory sequences as sometimes found in introns, contains sequences required for proper tissue, stage-specific, or disease-state specific expression.

The nucleic acid compositions of the subject invention can encode all or a part of the subject polypeptides. Double or single stranded fragments can be obtained from the DNA sequence by chemically synthesizing oligonucleotides in accordance with conventional methods, by restriction enzyme digestion, by PCR amplification, etc. Isolated polynucleotides and polynucleotide fragments of the invention comprise at least about 10, about 15, about 20, about 35, about 50, about 100, about 150 to about 200, about 250 to about 300, or about 350 contiguous nt selected from the polynucleotide sequences as shown in SEQ ID NOS:1–2707. For the most part, fragments will be of at least 15 nt, usually at least 18 nt or 25 nt, and up to at least about 50 contiguous nt in length or more. In a preferred embodiment, the polynucleotide molecules comprise a contiguous sequence of at least 12 nt selected from the group consisting of the polynucleotides shown in SEQ ID NOS:1–2707.

Probes specific to the polynucleotides of the invention can be generated using the polynucleotide sequences disclosed in SEQ ID NOS:1–2707. The probes are preferably at least about a 12, 15, 16, 18, 20, 22, 24, or 25 nt fragment of a corresponding contiguous sequence of SEQ ID NOS: 1–2707, and can be less than 2, 1, 0.5, 0.1, or 0.05 kb in length. The probes can be synthesized chemically or can be generated from longer polynucleotides using restriction enzymes. The probes can be labeled, for example, with a radioactive, biotinylated, or fluorescent tag. Preferably, probes are designed based upon an identifying sequence of a polynucleotide of one of SEQ ID NOS:1–2707. More preferably, probes are designed based on a contiguous sequence of one of the subject polynucleotides that remain unmasked following application of a masking program for masking low complexity (e.g., XBLAST) to the sequence., i.e., one would select an unmasked region, as indicated by the polynucleotides outside the poly-n stretches of the masked sequence produced by the masking program.

The polynucleotides of the subject invention are isolated and obtained in substantial purity, generally as other than an intact chromosome. Usually, the polynucleotides, either as DNA or RNA, will be obtained substantially free of other naturally-occurring nucleic acid sequences, generally being at least about 50%, usually at least about 90% pure and are typically "recombinant", e.g., flanked by one or more nucleotides with which it is not normally associated on a naturally occurring chromosome.

The polynucleotides of the invention can be provided as a linear molecule or within a circular molecule, and can be provided within autonomously replicating molecules (vectors) or within molecules without replication sequences. Expression of the polynucleotides can be regulated by their own or by other regulatory sequences known in the art. The polynucleotides of the invention can be introduced into suitable host cells using a variety of techniques available in the art, such as transferrin polycation-mediated DNA transfer, transfection with naked or encapsulated nucleic acids, liposome-mediated DNA transfer, intracellular transportation of DNA-coated latex beads, protoplast fusion, viral infection, electroporation, gene gun, calcium phosphate-mediated transfection, and the like.

The subject nucleic acid compositions can be used to, for example, produce polypeptides, as probes for the detection of mRNA of the invention in biological samples (e.g., extracts of human cells) to generate additional copies of the polynucleotides, to generate ribozymes or antisense oligonucleotides, and as single stranded DNA probes or as triple-strand forming oligonucleotides. The probes described herein can be used to, for example, determine the presence or absence of the polynucleotide sequences as shown in SEQ ID NOS:1–2707 or variants thereof in a sample. These and other uses are described in more detail below.

Use of Polynucleotides to Obtain Full-Length cDNA, Gene, and Promoter Region

Full-length cDNA molecules comprising the disclosed polynucleotides are obtained as follows. A polynucleotide having a sequence of one of SEQ ID NOS:1–2707, or a portion thereof comprising at least 12, 15, 18, or 20 nt, is used as a hybridization probe to detect hybridizing members of a cDNA library using probe design methods, cloning methods, and clone selection techniques such as those described in U.S. Pat. No. 5,654,173. Libraries of cDNA are made from selected tissues, such as normal or tumor tissue, or from tissues of a mammal treated with, for example, a pharmaceutical agent. Preferably, the tissue is the same as the tissue from which the polynucleotides of the invention were isolated, as both the polynucleotides described herein and the cDNA represent expressed genes. Most preferably, the cDNA library is made from the biological material described herein in the Examples. The choice of cell type for library construction can be made after the identity of the protein encoded by the gene corresponding to the polynucleotide of the invention is known. This will indicate which tissue and cell types are likely to express the related gene, and thus represent a suitable source for the mRNA for generating the cDNA. Where the provided polynucleotides are isolated from cDNA libraries, the libraries are prepared from mRNA of human colon cells, more preferably, human colon cancer cells, even more preferably, from a highly metastatic colon cell, Km 12L4-A.

Techniques for producing and probing nucleic acid sequence libraries are described, for example, in Sambrook et al., *Molecular Cloning: A Laboratory Manual, 2nd Ed.*, (1989) Cold Spring Harbor Press, Cold Spring Harbor, N.Y. The cDNA can be prepared by using primers based on sequence from SEQ ID NOS:1–2707. In one embodiment, the cDNA library can be made from only poly-adenylated mRNA. Thus, poly-T primers can be used to prepare cDNA from the mRNA.

Members of the library that are larger than the provided polynucleotides, and preferably that encompass the complete coding sequence of the native message, are obtained. In order to confirm that the entire cDNA has been obtained, RNA protection experiments are performed as follows. Hybridization of a full-length cDNA to an mRNA will protect the RNA from RNase degradation. If the cDNA is not full length, then the portions of the mRNA that are not hybridized will be subject to RNase degradation. This is assayed, as is known in the art, by changes in electrophoretic mobility on polyacrylamide gels, or by detection of released monoribonucleotides. Sambrook et al., *Molecular Cloning: A Laboratory Manual, 2nd Ed.*, (1989) Cold Spring Harbor Press, Cold Spring Harbor, N.Y. In order to obtain additional sequences 5' to the end of a partial cDNA, 5' RACE (PCR *Protocols: A Guide to Methods and Applications*, (1990) Academic Press, Inc.) can be performed.

Genomic DNA is isolated using the provided polynucleotides in a manner similar to the isolation of full-length cDNAs. Briefly, the provided polynucleotides, or portions thereof, are used as probes to libraries of genomic DNA. Preferably, the library is obtained from the cell type that was used to generate the polynucleotides of the invention, but this is not essential. Most preferably, the genomic DNA is obtained from the biological material described herein in the Examples. Such libraries can be in vectors suitable for carrying large segments of a genome, such as P1 or YAC, as described in detail in Sambrook et al., 9.4–9.30. In addition, genomic sequences can be isolated from human BAC libraries, which are commercially available from Research Genetics, Inc., Huntsville, Ala., USA, for example. In order to obtain additional 5' or 3' sequences, chromosome walking is performed, as described in Sambrook et al., such that adjacent and overlapping fragments of genomic DNA are isolated. These are mapped and pieced together, as is known in the art, using restriction digestion enzymes and DNA ligase.

Using the polynucleotide sequences of the invention, corresponding full-length genes can be isolated using both classical and PCR methods to construct and probe cDNA libraries. Using either method, Northern blots, preferably, are performed on a number of cell types to determine which cell lines express the gene of interest at the highest level. Classical methods of constructing cDNA libraries are taught in Sambrook et al., supra. With these methods, cDNA can be produced from mRNA and inserted into viral or expression vectors. Typically, libraries of mRNA comprising poly(A) tails can be produced with poly(T) primers. Similarly, cDNA libraries can be produced using the instant sequences as primers.

PCR methods are used to amplify the members of a cDNA library that comprise the desired insert. In this case, the desired insert will contain sequence from the full length cDNA that corresponds to the instant polynucleotides. Such PCR methods include gene trapping and RACE methods. Gene trapping entails inserting a member of a cDNA library into a vector. The vector then is denatured to produce single stranded molecules. Next, a substrate-bound probe, such a biotinylated oligo, is used to trap cDNA inserts of interest. Biotinylated probes can be linked to an avidin-bound solid substrate. PCR methods can be used to amplify the trapped cDNA. To trap sequences corresponding to the full length genes, the labeled probe sequence is based on the polynucleotide sequences of the invention. Random primers or primers specific to the library vector can be used to amplify the trapped cDNA. Such gene trapping techniques are described in Gruber et al., WO 95/04745 and Gruber et al., U.S. Pat. No. 5,500,356. Kits are commercially available to perform gene trapping experiments from, for example, Life Technologies, Gaithersburg, Md., USA.

"Rapid amplification of cDNA ends," or RACE, is a PCR method of amplifying cDNAs from a number of different RNAs. The cDNAs are ligated to an oligonucleotide linker, and amplified by PCR using two primers. One primer is based on sequence from the instant polynucleotides, for which full length sequence is desired, and a second primer comprises sequence that hybridizes to the oligonucleotide linker to amplify the cDNA. A description of this methods is reported in WO 97/19110. In preferred embodiments of RACE, a common primer is designed to anneal to an arbitrary adaptor sequence ligated to cDNA ends (Apte and Siebert, *Biotechniques* (1993) 15:890–893; Edwards et al., *Nuc. Acids Res.* (1991) 19:5227–5232). When a single gene-specific RACE primer is paired with the common primer, preferential amplification of sequences between the single gene specific primer and the common primer occurs. Commercial cDNA pools modified for use in RACE are available.

Another PCR-based method generates full-length cDNA library with anchored ends without needing specific knowledge of the cDNA sequence. The method uses lock-docking primers (I–VI), where one primer, poly TV (I–III) locks over the polyA tail of eukaryotic mRNA producing first strand synthesis and a second primer, polyGH (IV–VI) locks onto the polyC tail added by terminal deoxynucleotidyl transferase (TdT)(see, e.g., WO 96/40998).

The promoter region of a gene generally is located 5' to the initiation site for RNA polymerase II. Hundreds of promoter regions contain the "TATA" box, a sequence such as TATTA or TATAA, which is sensitive to mutations. The promoter region can be obtained by performing 5' RACE using a primer from the coding region of the gene. Alternatively, the cDNA can be used as a probe for the genomic sequence, and the region 5' to the coding region is identified by "walking up." If the gene is highly expressed or differentially expressed, the promoter from the gene can be of use in a regulatory construct for a heterologous gene.

Once the full-length cDNA or gene is obtained, DNA encoding variants can be prepared by site-directed mutagenesis, described in detail in Sambrook et al., 15.3–15.63. The choice of codon or nucleotide to be replaced can be based on disclosure herein on optional changes in amino acids to achieve altered protein structure and/or function.

As an alternative method to obtaining DNA or RNA from a biological material, nucleic acid comprising nucleotides having the sequence of one or more polynucleotides of the invention can be synthesized. Thus, the invention encompasses nucleic acid molecules ranging in length from 15 nt (corresponding to at least 15 contiguous nt of one of SEQ ID NOS:1–2707) up to a maximum length suitable for one or more biological manipulations, including replication and expression, of the nucleic acid molecule. The invention includes but is not limited to (a) nucleic acid having the size of a full gene, and comprising at least one of SEQ ID NOS:1–2707; (b) the nucleic acid of (a) also comprising at least one additional gene, operably linked to permit expression of a fusion protein; (c) an expression vector comprising (a) or (b); (d) a plasmid comprising (a) or (b); and (e) a recombinant viral particle comprising (a) or (b). Once provided with the polynucleotides disclosed herein, construction or preparation of (a)–(e) are well within the skill in the art.

The sequence of a nucleic acid comprising at least 15 contiguous nt of at least any one of SEQ ID NOS:1–2707, preferably the entire sequence of at least any one of SEQ ID NOS:1–2707, is not limited and can be any sequence of A, T, G, and/or C (for DNA) and A, U, G, and/or C (for RNA) or modified bases thereof, including inosine and pseudouridine. The choice of sequence will depend on the desired function and can be dictated by coding regions desired, the intron-like regions desired, and the regulatory regions desired. Where the entire sequence of any one of SEQ ID NOS:1–2707 is within the nucleic acid, the nucleic acid obtained is referred to herein as a polynucleotide comprising the sequence of any one of SEQ ID NOS:1–2707.

Expression of Polypeptide Encoded by Full-Length cDNA or Full-Length Gene

The provided polynucleotides (e.g., a polynucleotide having a sequence of one of SEQ ID NOS:1–2707), the corresponding cDNA, or the full-length gene is used to express a partial or complete gene product. Constructs of polynucleotides having sequences of SEQ ID NOS:1–2707 can also be generated synthetically. Alternatively, single-step assembly of a gene and entire plasmid from large numbers of oligodeoxyribonucleotides is described by, e.g., Stemmer et al., *Gene (Amsterdam)* (1995) 164(1):49–53. In this method, assembly PCR (the synthesis of long DNA sequences from large numbers of oligodeoxyribonucleotides (oligos)) is described. The method is derived from DNA shuffling (Stemmer, *Nature* (1994) 370:389–391), and does not rely on DNA ligase, but instead relies on DNA polymerase to build increasingly longer DNA fragments during the assembly process.

Appropriate polynucleotide constructs are purified using standard recombinant DNA techniques as described in, for example, Sambrook et al., *Molecular Cloning: A Laboratory Manual, 2nd Ed.*, (1989) Cold Spring Harbor Press, Cold Spring Harbor, N.Y., and under current regulations described in United States Dept. of HHS, National Institute of Health (NIH) Guidelines for Recombinant DNA Research. The gene product encoded by a polynucleotide of the invention is expressed in any expression system, including, for example, bacterial, yeast, insect, amphibian and mammalian systems. Vectors, host cells and methods for obtaining expression in same are well known in the art. Suitable vectors and host cells are described in U.S. Pat. No. 5,654,173.

Polynucleotide molecules comprising a polynucleotide sequence provided herein are generally propagated by placing the molecule in a vector. Viral and non-viral vectors are used, including plasmids. The choice of plasmid will depend on the type of cell in which propagation is desired and the purpose of propagation. Certain vectors are useful for amplifying and making large amounts of the desired DNA sequence. Other vectors are suitable for expression in cells in culture. Still other vectors are suitable for transfer and expression in cells in a whole animal or person. The choice of appropriate vector is well within the skill of the art. Many such vectors are available commercially. Methods for preparation of vectors comprising a desired sequence are well known in the art.

The polynucleotides set forth in SEQ ID NOS:1–2707 or their corresponding full-length polynucleotides are linked to regulatory sequences as appropriate to obtain the desired expression properties. These can include promoters (attached either at the 5' end of the sense strand or at the 3' end of the antisense strand), enhancers, terminators, operators, repressors, and inducers. The promoters can be regulated or constitutive. In some situations it may be desirable to use conditionally active promoters, such as tissue-specific or developmental stage-specific promoters. These are linked to the desired nucleotide sequence using the techniques described above for linkage to vectors. Any techniques known in the art can be used.

When any of the above host cells, or other appropriate host cells or organisms, are used to replicate and/or express the polynucleotides or nucleic acids of the invention, the resulting replicated nucleic acid, RNA, expressed protein or polypeptide, is within the scope of the invention as a product of the host cell or organism. The product is recovered by any appropriate means known in the art.

Once the gene corresponding to a selected polynucleotide is identified, its expression can be regulated in the cell to which the gene is native. For example, an endogenous gene of a cell can be regulated by an exogenous regulatory sequence as disclosed in U.S. Pat. No. 5,641,670.

Identification of Functional and Structural Motifs of Novel Genes Screening Against Publicly Available Databases Translations of the nucleotide sequence of the provided polynucleotides, cDNAs or full genes can be aligned with individual known sequences. Similarity with individual sequences can be used to determine the activity of the polypeptides encoded by the polynucleotides of the invention. Also, sequences exhibiting similarity with more than one individual sequence can exhibit activities that are characteristic of either or both individual sequences.

The full length sequences and fragments of the polynucleotide sequences of the nearest neighbors can be used as probes and primers to identify and isolate the full length sequence corresponding to provided polynucleotides. The nearest neighbors can indicate a tissue or cell type to be used to construct a library for the full-length sequences corresponding to the provided polynucleotides.

Typically, a selected polynucleotide is translated in all six frames to determine the best alignment with the individual sequences. The sequences disclosed herein in the Sequence Listing are in a 5' to 3' orientation and translation in three frames can be sufficient (with a few specific exceptions as described in the Examples). These amino acid sequences are referred to, generally, as query sequences, which will be aligned with the individual sequences. Databases with individual sequences are described in "Computer Methods for Macromolecular Sequence Analysis" *Methods in Enzymology* (1996) 266, Doolittle, Academic Press, Inc., a division of Harcourt Brace & Co., San Diego, Calif., USA. Databases include GenBank, EMBL, and DNA Database of Japan (DDBJ).

Query and individual sequences can be aligned using the methods and computer programs described above, and include BLAST 2.0, available over the world wide web at ncbi.nlm.nih.gov/BLAST. See also Altschul, et al. *Nucleic Acids Res.* (1997) 25:3389–3402. Another alignment algorithm is Fasta, available in the Genetics Computing Group (GCG) package, Madison, Wis., USA, a wholly owned subsidiary of Oxford Molecular Group, Inc. Other techniques for alignment are described in Doolittle, supra. Preferably, an alignment program that permits gaps in the sequence is utilized to align the sequences. The Smith-Waterman is one type of algorithm that permits gaps in sequence alignments. See *Meth. Mol. Biol.* (1997) 70: 173–187. Also, the GAP program using the Needleman and Wunsch alignment method can be utilized to align sequences. An alternative search strategy uses MPSRCH software, which runs on a MASPAR computer. MPSRCH uses a Smith-Waterman algorithm to score sequences on a massively parallel computer. This approach improves ability to identify sequences that are distantly related matches, and is especially tolerant of small gaps and nucleotide sequence errors. Amino acid sequences encoded by the provided polynucleotides can be used to search both protein and DNA databases. Incorporated herein by reference are all sequences that have been made public as of the filing date of this application by any of the DNA or protein sequence databases, including the patent databases (e.g., GeneSeq). Also incorporated by reference are those sequences that have been submitted to these databases as of the filing date of the present application but not made public until after the filing date of the present application.

Results of individual and query sequence alignments can be divided into three categories: high similarity, weak similarity, and no similarity. Individual alignment results ranging from high similarity to weak similarity provide a basis for determining polypeptide activity and/or structure. Parameters for categorizing individual results include: percentage of the alignment region length where the strongest alignment is found, percent sequence identity, and p value. The percentage of the alignment region length is calculated by counting the number of residues of the individual sequence found in the region of strongest alignment, e.g., contiguous region of the individual sequence that contains the greatest number of residues that are identical to the residues of the corresponding region of the aligned query sequence. This number is divided by the total residue length of the query sequence to calculate a percentage. For example, a query sequence of 20 amino acid residues might be aligned with a 20 amino acid region of an individual sequence. The individual sequence might be identical to amino acid residues 5, 9–15, and 17–19 of the query sequence. The region of strongest alignment is thus the region stretching from residue 9–19, an 11 amino acid stretch. The percentage of the alignment region length is: 11 (length of the region of strongest alignment) divided by (query sequence length) 20 or 55%.

Percent sequence identity is calculated by counting the number of amino acid matches between the query and individual sequence and dividing total number of matches by the number of residues of the individual sequences found in the region of strongest alignment. Thus, the percent identity in the example above would be 10 matches divided by 11 amino acids, or approximately, 90.9%

P value is the probability that the alignment was produced by chance. For a single alignment, the p value can be calculated according to Karlin et al., *Proc. Natl. Acad. Sci.* (1990) 87:2264 and Karlin et al., *Proc. Natl. Acad. Sci.* (1993) 90. The p value of multiple alignments using the same query sequence can be calculated using an heuristic approach described in Altschul et al., *Nat. Genet.* (1994) 6:119. Alignment programs such as BLAST program can calculate the p value. See also Altschul et al., *Nucleic Acids Res.* (1997) 25:3389–3402.

Another factor to consider for determining identity or similarity is the location of the similarity or identity. Strong local alignment can indicate similarity even if the length of alignment is short. Sequence identity scattered throughout the length of the query sequence also can indicate a similarity between the query and profile sequences. The boundaries of the region where the sequences align can be determined according to Doolittle, supra; BLAST 2.0 (see, e.g., Altschul, et al. *Nucleic Acids Res.* (1997) 25:3389–3402) or FAST programs; or by determining the area where sequence identity is highest.

High Similarity. In general, in alignment results considered to be of high similarity, the percent of the alignment region length is typically at least about 55% of total length query sequence; more typically, at least about 58%; even more typically; at least about 60% of the total residue length of the query sequence. Usually, percent length of the alignment region can be as much as about 62%; more usually, as much as about 64%; even more usually, as much as about 66%. Further, for high similarity, the region of alignment, typically, exhibits at least about 75% of sequence identity; more typically, at least about 78%; even more typically; at least about 80% sequence identity. Usually, percent sequence identity can be as much as about 82%; more usually, as much as about 84%; even more usually, as much as about 86%.

The p value is used in conjunction with these methods. If high similarity is found, the query sequence is considered to have high similarity with a profile sequence when the p value is less than or equal to about $10^{-2}$; more usually; less than or equal to about $10^{-3}$; even more usually; less than or equal to about $10^{-4}$ More typically, the p value is no more than about $10^{-5}$; more typically; no more than or equal to about $10^{-10}$; even more typically; no more than or equal to about $10^{-15}$ for the query sequence to be considered high similarity.

Weak Similarity. In general, where alignment results considered to be of weak similarity, there is no minimum percent length of the alignment region nor minimum length of alignment. A better showing of weak similarity is considered when the region of alignment is, typically, at least about 15 amino acid residues in length; more typically, at least about 20; even more typically; at least about 25 amino acid residues in length. Usually, length of the alignment region can be as much as about 30 amino acid residues; more usually, as much as about 40; even more usually, as much as about 60 amino acid residues. Further, for weak similarity, the region of alignment, typically, exhibits at least about 35% of sequence identity; more typically, at least about 40%; even more typically; at least about 45% sequence identity. Usually, percent sequence identity can be as much as about 50%; more usually, as much as about 55%; even more usually, as much as about 60%.

If low similarity is found, the query sequence is considered to have weak similarity with a profile sequence when the p value is usually less than or equal to about $10^{-2}$; more usually; less than or equal to about $10^{-3}$; even more usually; less than or equal to about $10^{-4}$. More typically, the p value is no more than about $10^{-5}$; more usually; no more than or equal to about $10^{-10}$; even more usually; no more than or equal to about $10^{-15}$ for the query sequence to be considered weak similarity.

Similarity Determined by Sequence Identity Alone. Sequence identity alone can be used to determine similarity of a query sequence to an individual sequence and can indicate the activity of the sequence. Such an alignment, preferably, permits gaps to align sequences. Typically, the query sequence is related to the profile sequence if the sequence identity over the entire query sequence is at least about 15%; more typically, at least about 20%; even more typically, at least about 25%; even more typically, at least about 50%. Sequence identity alone as a measure of similarity is most useful when the query sequence is usually, at least 80 residues in length; more usually, 90 residues; even more usually, at least 95 amino acid residues in length. More typically, similarity can be concluded based on sequence identity alone when the query sequence is preferably 100 residues in length; more preferably, 120 residues in length; even more preferably, 150 amino acid residues in length.

Alignments with Profile and Multiple Aligned Sequences. Translations of the provided polynucleotides can be aligned with amino acid profiles that define either protein families or common motifs. Also, translations of the provided polynucleotides can be aligned to multiple sequence alignments (MSA) comprising the polypeptide sequences of members of protein families or motifs. Similarity or identity with profile sequences or MSAs can be used to determine the activity of the gene products (e.g., polypeptides) encoded by the provided polynucleotides or corresponding cDNA or genes. For example, sequences that show an identity or similarity with a chemokine profile or MSA can exhibit chemokine activities.

Profiles can designed manually by (1) creating an MSA, which is an alignment of the amino acid sequence of members that belong to the family and (2) constructing a statistical representation of the alignment. Such methods are described, for example, in Birney et al., *Nucl. Acid Res.* (1996) 24(14): 2730–2739. MSAs of some protein families and motifs are publicly available. For example, genome.wustl.edu/Pfam includes MSAs of 547 different families and motifs. These MSAs are described also in Sonnhammer et al., *Proteins* (1997) 28: 405–420. Other sources over the world wide web include the site at embl-heidelberg.de/argos/ali/ali. A brief description of these MSAs is reported in Pascarella et al., *Prot. Eng.* (1996) 9(3):249–251. Techniques for building profiles from MSAs are described in Sonnhammer et al., supra; Birney et al., supra; and "Computer Methods for Macromolecular Sequence Analysis," *Methods in Enzymology* (1996) 266, Doolittle, Academic Press, Inc., San Diego, Calif., USA.

Similarity between a query sequence and a protein family or motif can be determined by (a) comparing the query sequence against the profile and/or (b) aligning the query sequence with the members of the family or motif. Typically, a program such as Searchwise is used to compare the query sequence to the statistical representation of the multiple alignment, also known as a profile (see Birney et al., supra). Other techniques to compare the sequence and profile are described in Sonnhammer et al., supra and Doolittle, supra.

Next, methods described by Feng et al., *J. Mol. Evol.* (1987) 25:351 and Higgins et al., *CABIOS* (1989) 5:151 can be used align the query sequence with the members of a family or motif, also known as a MSA. Sequence alignments can be generated using any of a variety of software tools. Examples include PileUp, which creates a multiple sequence alignment, and is described in Feng et al, *J. Mol. Evol.* (1987) 25:351. Another method, GAP, uses the alignment method of Needleman et al., *J. Mol. Biol.* (1970) 48:443. GAP is best suited for global alignment of sequences. A third method, BestFit, functions by inserting gaps to maximize the number of matches using the local homology algorithm of Smith et al., *Adv. Appl. Math.* (1981) 2:482. In general, the following factors are used to determine if a similarity between a query sequence and a profile or MSA exists: (1) number of conserved residues found in the query sequence, (2) percentage of conserved residues found in the query sequence, (3) number of frameshifts, and (4) spacing between conserved residues.

Some alignment programs that both translate and align sequences can make any number of frameshifts when translating the nucleotide sequence to produce the best alignment. The fewer frameshifts needed to produce an alignment, the stronger the similarity or identity between the query and profile or MSAs. For example, a weak similarity resulting from no frameshifts can be a better indication of activity or structure of a query sequence, than a strong similarity resulting from two frameshifts. Preferably, three or fewer frameshifts are found in an alignment; more preferably two or fewer frameshifts; even more preferably, one or fewer frameshifts; even more preferably, no frameshifts are found in an alignment of query and profile or MSAs.

Conserved residues are those amino acids found at a particular position in all or some of the family or motif members. Alternatively, a position is considered conserved if only a certain class of amino acids is found in a particular position in all or some of the family members. For example, the N-terminal position can contain a positively charged amino acid, such as lysine, arginine, or histidine.

Typically, a residue of a polypeptide is conserved when a class of amino acids or a single amino acid is found at a particular position in at least about 40% of all class members; more typically, at least about 50%; even more typically, at least about 60% of the members. Usually, a residue is conserved when a class or single amino acid is found in at least about 70% of the members of a family or motif; more usually, at least about 80%; even more usually, at least about 90%; even more usually, at least about 95%.

A residue is considered conserved when three unrelated amino acids are found at a particular position in the some or all of the members; more usually, two unrelated amino acids. These residues are conserved when the unrelated amino acids are found at particular positions in at least about 40% of all class member; more typically, at least about 50%; even more typically, at least about 60% of the members. Usually, a residue is conserved when a class or single amino acid is found in at least about 70% of the members of a family or motif; more usually, at least about 80%; even more usually, at least about 90%; even more usually, at least about 95%.

A query sequence has similarity to a profile or MSA when the query sequence comprises at least about 25% of the conserved residues of the profile or MSA; more usually, at least about 30%; even more usually; at least about 40%. Typically, the query sequence has a stronger similarity to a profile sequence or MSA when the query sequence comprises at least about 45% of the conserved residues of the profile or MSA; more typically, at least about 50%; even more typically; at least about 55%.

Identification of Secreted & Membrane-Bound Polypeptides

Both secreted and membrane-bound polypeptides of the present invention are of particular interest. For example, levels of secreted polypeptides can be assayed in body fluids that are convenient, such as blood, plasma, serum, and other body fluids such as urine, prostatic fluid and semen. Membrane-bound polypeptides are useful for constructing vaccine antigens or inducing an immune response. Such antigens would comprise all or part of the extracellular region of the membrane-bound polypeptides. Because both secreted and membrane-bound polypeptides comprise a fragment of contiguous hydrophobic amino acids, hydrophobicity predicting algorithms can be used to identify such polypeptides.

A signal sequence is usually encoded by both secreted and membrane-bound polypeptide genes to direct a polypeptide to the surface of the cell. The signal sequence usually comprises a stretch of hydrophobic residues. Such signal sequences can fold into helical structures. Membrane-bound polypeptides typically comprise at least one transmembrane region that possesses a stretch of hydrophobic amino acids that can transverse the membrane. Some transmembrane regions also exhibit a helical structure. Hydrophobic fragments within a polypeptide can be identified by using computer algorithms. Such algorithms include Hopp & Woods, *Proc. Natl. Acad. Sci. USA* (1981) 78:3824–3828; Kyte & Doolittle, *J. Mol. Biol.* (1982) 157:105–132; and RAOAR algorithm, Degli Esposti et al., *Eur. J. Biochem.* (1990) 190: 207–219.

Another method of identifying secreted and membrane-bound polypeptides is to translate the polynucleotides of the invention in all six frames and determine if at least 8 contiguous hydrophobic amino acids are present. Those translated polypeptides with at least 8; more typically, 10; even more typically, 12 contiguous hydrophobic amino acids are considered to be either a putative secreted or membrane bound polypeptide. Hydrophobic amino acids include alanine, glycine, histidine, isoleucine, leucine, lysine, methionine, phenylalanine, proline, threonine, tryptophan, tyrosine, and valine Identification of the Function of an Expression Product of a Full-Length Gene Ribozymes, antisense constructs, and dominant negative mutants can be used to determine function of the expression product of a gene corresponding to a polynucleotide provided herein. These methods and compositions are particularly useful where the provided novel polynucleotide exhibits no significant or substantial homology to a sequence encoding a gene of known function. Antisense molecules and ribozymes can be constructed from synthetic polynucleotides. Typically, the phosphoramidite method of oligonucleotide synthesis is used. See Beaucage et al., *Tet. Lett.* (1981) 22:1859 and U.S. Pat. No. 4,668,777. Automated devices for synthesis are available to create oligonucleotides using this chemistry. Examples of such devices include Biosearch 8600, Models 392 and 394 by Applied Biosystems, a division of Perkin-Elmer Corp., Foster City, Calif., USA; and Expedite by Perceptive Biosystems, Framingham, Mass., USA. Synthetic RNA, phosphate analog oligonucleotides, and chemically derivatized oligonucleotides can also be produced, and can be covalently attached to other molecules. RNA oligonucleotides can be synthesized, for example, using RNA phosphoramidites. This method can be performed on an automated synthesizer, such as Applied Biosystems, Models 392 and 394, Foster City, Calif., USA.

Phosphorothioate oligonucleotides can also be synthesized for antisense construction. A sulfurizing reagent, such as tetraethylthiruam disulfide (TETD) in acetonitrile can be used to convert the internucleotide cyanoethyl phosphite to the phosphorothioate triester within 15 minutes at room temperature. TETD replaces the iodine reagent, while all other reagents used for standard phosphoramidite chemistry remain the same. Such a synthesis method can be automated using Models 392 and 394 by Applied Biosystems, for example.

Oligonucleotides of up to 200 nt can be synthesized, more typically, 100 nt, more typically 50 nt; even more typically 30 to 40 nt. These synthetic fragments can be annealed and ligated together to construct larger fragments. See, for example, Sambrook et al., supra. Trans-cleaving catalytic RNAs (ribozymes) are RNA molecules possessing endoribonuclease activity. Ribozymes are specifically designed for a particular target, and the target message must contain a specific nucleotide sequence. They are engineered to cleave any RNA species site-specifically in the background of cellular RNA. The cleavage event renders the mRNA unstable and prevents protein expression. Importantly, ribozymes can be used to inhibit expression of a gene of unknown function for the purpose of determining its function in an in vitro or in vivo context, by detecting the phenotypic effect. One commonly used ribozyme motif is the hammerhead, for which the substrate sequence requirements are minimal. Design of the hammerhead ribozyme, as well as therapeutic uses of ribozymes, are disclosed in Usman et al., *Current Opin. Struct. Biol.* (1996) 6:527. Methods for production of ribozymes, including hairpin structure ribozyme fragments, methods of increasing ribozyme specificity, and the like are known in the art.

The hybridizing region of the ribozyme can be modified or can be prepared as a branched structure as described in Horn and Urdea, *Nucleic Acids Res.* (1989) 17:6959. The basic structure of the ribozymes can also be chemically altered in ways familiar to those skilled in the art, and chemically synthesized ribozymes can be administered as synthetic oligonucleotide derivatives modified by monomeric units. In a therapeutic context, liposome mediated delivery of ribozymes improves cellular uptake, as described in Birikh et al., *Eur. J. Biochem.* (1997) 245:1.

Antisense nucleic acids are designed to specifically bind to RNA, resulting in the formation of RNA-DNA or RNA-RNA hybrids, with an arrest of DNA replication, reverse transcription or messenger RNA translation. Antisense polynucleotides based on a selected polynucleotide sequence can interfere with expression of the corresponding gene. Antisense polynucleotides are typically generated within the cell by expression from antisense constructs that contain the antisense strand as the transcribed strand. Antisense polynucleotides based on the disclosed polynucleotides will bind and/or interfere with the translation of mRNA comprising a sequence complementary to the antisense polynucleotide. The expression products of control cells and cells treated with the antisense construct are compared to detect the protein product of the gene corresponding to the polynucleotide upon which the antisense construct is based. The protein is isolated and identified using routine biochemical methods.

Given the extensive background literature and clinical experience in antisense therapy, one skilled in the art can use selected polynucleotides of the invention as additional potential therapeutics. The choice of polynucleotide can be narrowed by first testing them for binding to "hot spot" regions of the genome of cancerous cells. If a polynucleotide is identified as binding to a "hot spot", testing the polynucleotide as an antisense compound in the corresponding cancer cells is warranted.

As an alternative method for identifying function of the gene corresponding to a polynucleotide disclosed herein, dominant negative mutations are readily generated for corresponding proteins that are active as homomultimers. A mutant polypeptide will interact with wild-type polypeptides (made from the other allele) and form a non-functional multimer. Thus, a mutation is in a substrate-binding domain, a catalytic domain, or a cellular localization domain. Preferably, the mutant polypeptide will be overproduced. Point mutations are made that have such an effect. In addition, fusion of different polypeptides of various lengths to the terminus of a protein can yield dominant negative mutants. General strategies are available for making dominant negative mutants (see, e.g., Herskowitz, *Nature* (1987) 329:219). Such techniques can be used to create loss of function mutations, which are useful for determining protein function.

Polypeptides and Variants Thereof

The polypeptides of the invention include those encoded by the disclosed polynucleotides, as well as nucleic acids that, by virtue of the degeneracy of the genetic code, are not identical in sequence to the disclosed polynucleotides. Thus, the invention includes within its scope a polypeptide encoded by a polynucleotide having the sequence of any one of SEQ ID NOS:1–2707 or a variant thereof.

In general, the term "polypeptide" as used herein refers to both the full length polypeptide encoded by the recited polynucleotide, the polypeptide encoded by the gene represented by the recited polynucleotide, as well as portions or fragments thereof. "Polypeptides" also includes variants of the naturally occurring proteins, where such variants are homologous or substantially similar to the naturally occurring protein, and can be of an origin of the same or different species as the naturally occurring protein (e.g., human, murine, or some other species that naturally expresses the recited polypeptide, usually a mammalian species). In general, variant polypeptides have a sequence that has at least about 80%, usually at least about 90%, and more usually at least about 98% sequence identity with a differentially expressed polypeptide of the invention, as measured by BLAST 2.0 using the parameters described above. The variant polypeptides can be naturally or non-naturally glycosylated, i.e., the polypeptide has a glycosylation pattern that differs from the glycosylation pattern found in the corresponding naturally occurring protein.

The invention also encompasses homologs of the disclosed polypeptides (or fragments thereof) where the homologs are isolated from other species, i.e. other animal or plant species, where such homologs, usually mammalian species, e.g. rodents, such as mice, rats; domestic animals, e.g., horse, cow, dog, cat; and humans. By "homolog" is meant a polypeptide having at least about 35%, usually at least about 40% and more usually at least about 60% amino acid sequence identity to a particular differentially expressed protein as identified above, where sequence identity is determined using the BLAST 2.0 algorithm, with the parameters described supra.

In general, the polypeptides of the subject invention are provided in a non-naturally occurring environment, e.g. are separated from their naturally occurring environment. In certain embodiments, the subject protein is present in a composition that is enriched for the protein as compared to a control. As such, purified polypeptide is provided, where by purified is meant that the protein is present in a composition that is substantially free of non-differentially expressed polypeptides, where by substantially free is meant that less than 90%, usually less than 60% and more usually less than 50% of the composition is made up of non-differentially expressed polypeptides.

Also within the scope of the invention are variants; variants of polypeptides include mutants, fragments, and fusions. Mutants can include amino acid substitutions, additions or deletions. The amino acid substitutions can be conservative amino acid substitutions or substitutions to eliminate non-essential amino acids, such as to alter a glycosylation site, a phosphorylation site or an acetylation site, or to minimize misfolding by substitution or deletion of one or more cysteine residues that are not necessary for function. Conservative amino acid substitutions are those that preserve the general charge, hydrophobicity/hydrophilicity, and/or steric bulk of the amino acid substituted. Variants can be designed so as to retain or have enhanced biological activity of a particular region of the protein (e.g., a functional domain and/or, where the polypeptide is a member of a protein family, a region associated with a consensus sequence). Selection of amino acid alterations for production of variants can be based upon the accessibility (interior vs. exterior) of the amino acid (see, e.g., Go et al, *Int. J. Peptide Protein Res.* (1980) 15:211), the thermostability of the variant polypeptide (see, e.g., Querol et al., *Prot.*

*Eng.* (1996) 9:265), desired glycosylation sites (see, e.g., Olsen and Thomsen, *J. Gen. Microbiol.* (1991) 137:579), desired disulfide bridges (see, e.g., Clarke et al., *Biochemistry* (1993) 32:4322; and Wakarchuk et al., *Protein Eng.* (1994) 7:1379), desired metal binding sites (see, e.g., Toma et al., *Biochemistry* (1991) 30:97, and Haezerbrouck et al., *Protein Eng.* (1993) 6:643), and desired substitutions with in proline loops (see, e.g., Masul et al., *Appl. Env. Microbiol.* (1994) 60:3579). Cysteine-depleted muteins can be produced as disclosed in U.S. Pat. No. 4,959,314.

Variants also include fragments of the polypeptides disclosed herein, particularly biologically active fragments and/or fragments corresponding to functional domains. Fragments of interest will typically be at least about 10 aa to at least about 15 aa in length, usually at least about 50 aa in length, and can be as long as 300 aa in length or longer, but will usually not exceed about 1000 aa in length, where the fragment will have a stretch of amino acids that is identical to a polypeptide encoded by a polynucleotide having a sequence of any SEQ ID NOS:1–2707, or a homolog thereof. The protein variants described herein are encoded by polynucleotides that are within the scope of the invention. The genetic code can be used to select the appropriate codons to construct the corresponding variants.

Computer-Related Embodiments

In general, a library of polynucleotides is a collection of sequence information, which information is provided in either biochemical form (e.g., as a collection of polynucleotide molecules), or in electronic form (e.g., as a collection of polynucleotide sequences stored in a computer-readable form, as in a computer system and/or as part of a computer program). The sequence information of the polynucleotides can be used in a variety of ways, e.g., as a resource for gene discovery, as a representation of sequences expressed in a selected cell type (e.g., cell type markers), and/or as markers of a given disease or disease state. In general, a disease marker is a representation of a gene product that is present in all cells affected by disease either at an increased or decreased level relative to a normal cell (e.g., a cell of the same or similar type that is not substantially affected by disease). For example, a polynucleotide sequence in a library can be a polynucleotide that represents an mRNA, polypeptide, or other gene product encoded by the polynucleotide, that is either overexpressed or underexpressed in a breast ductal cell affected by cancer relative to a normal (i.e., substantially disease-free) breast cell.

The nucleotide sequence information of the library can be embodied in any suitable form, e.g., electronic or biochemical forms. For example, a library of sequence information embodied in electronic form comprises an accessible computer data file (or, in biochemical form, a collection of nucleic acid molecules) that contains the representative nucleotide sequences of genes that are differentially expressed (e.g., overexpressed or underexpressed) as between, for example, i) a cancerous cell and a normal cell; ii) a cancerous cell and a dysplastic cell; iii) a cancerous cell and a cell affected by a disease or condition other than cancer; iv) a metastatic cancerous cell and a normal cell and/or non-metastatic cancerous cell; v) a malignant cancerous cell and a non-malignant cancerous cell (or a normal cell) and/or vi) a dysplastic cell relative to a normal cell. Other combinations and comparisons of cells affected by various diseases or stages of disease will be readily apparent to the ordinarily skilled artisan. Biochemical embodiments of the library include a collection of nucleic acids that have the sequences of the genes in the library, where the nucleic acids can correspond to the entire gene in the library or to a fragment thereof, as described in greater detail below.

The polynucleotide libraries of the subject invention generally comprise sequence information of a plurality of polynucleotide sequences, where at least one of the polynucleotides has a sequence of any of SEQ ID NOS:1–2707. By plurality is meant at least 2, usually at least 3 and can include up to all of SEQ ID NOS:1–2707. The length and number of polynucleotides in the library will vary with the nature of the library, e.g., if the library is an oligonucleotide array, a cDNA array, a computer database of the sequence information, etc.

Where the library is an electronic library, the nucleic acid sequence information can be present in a variety of media. "Media" refers to a manufacture, other than an isolated nucleic acid molecule, that contains the sequence information of the present invention. Such a manufacture provides the genome sequence or a subset thereof in a form that can be examined by means not directly applicable to the sequence as it exists in a nucleic acid. For example, the nucleotide sequence of the present invention, e.g. the nucleic acid sequences of any of the polynucleotides of SEQ ID NOS:1–2707, can be recorded on computer readable media, e.g. any medium that can be read and accessed directly by a computer. Such media include, but are not limited to: magnetic storage media, such as a floppy disc, a hard disc storage medium, and a magnetic tape; optical storage media such as CD-ROM; electrical storage media such as RAM and ROM; and hybrids of these categories such as magnetic/optical storage media. One of skill in the art can readily appreciate how any of the presently known computer readable mediums can be used to create a manufacture comprising a recording of the present sequence information. "Recorded" refers to a process for storing information on computer readable medium, using any such methods as known in the art. Any convenient data storage structure can be chosen, based on the means used to access the stored information. A variety of data processor programs and formats can be used for storage, e.g. word processing text file, database format, etc. In addition to the sequence information, electronic versions of the libraries of the invention can be provided in conjunction or connection with other computer-readable information and/or other types of computer-readable files (e.g., searchable files, executable files, etc, including, but not limited to, for example, search program software, etc.).

By providing the nucleotide sequence in computer readable form, the information can be accessed for a variety of purposes. Computer software to access sequence information is publicly available. For example, the gapped BLAST (Altschul et al. *Nucleic Acids Res*. (1997) 25:3389–3402) and BLAZE (Brutlag et al. *Comp. Chem.* (1993) 17:203) search algorithms on a Sybase system can be used to identify open reading frames (ORFs) within the genome that contain homology to ORFs from other organisms.

As used herein, "a computer-based system" refers to the hardware means, software means, and data storage means used to analyze the nucleotide sequence information of the present invention. The minimum hardware of the computer-based systems of the present invention comprises a central processing unit (CPU), input means, output means, and data storage means. A skilled artisan can readily appreciate that any one of the currently available computer-based system are suitable for use in the present invention. The data storage means can comprise any manufacture comprising a recording of the present sequence information as described above, or a memory access means that can access such a manufacture.

"Search means" refers to one or more programs implemented on the computer-based system, to compare a target sequence or target structural motif, or expression levels of a polynucleotide in a sample, with the stored sequence information. Search means can be used to identify fragments or regions of the genome that match a particular target sequence or target motif. A variety of known algorithms are publicly known and commercially available, e.g. MacPattern (EMBL), BLASTN and BLASTX (NCBI). A "target sequence" can be any polynucleotide or amino acid sequence of six or more contiguous nucleotides or two or more amino acids, preferably from about 10 to 100 amino acids or from about 30 to 300 nt A variety of comparing means can be used to accomplish comparison of sequence information from a sample (e.g., to analyze target sequences, target motifs, or relative expression levels) with the data storage means. A skilled artisan can readily recognize that any one of the publicly available homology search programs can be used as the search means for the computer based systems of the present invention to accomplish comparison of target sequences and motifs. Computer programs to analyze expression levels in a sample and in controls are also known in the art.

A "target structural motif," or "target motif," refers to any rationally selected sequence or combination of sequences in which the sequence(s) are chosen based on a three-dimensional configuration that is formed upon the folding of the target motif, or on consensus sequences of regulatory or active sites. There are a variety of target motifs known in the art. Protein target motifs include, but are not limited to, enzyme active sites and signal sequences. Nucleic acid target motifs include, but are not limited to, hairpin structures, promoter sequences and other expression elements such as binding sites for transcription factors.

A variety of structural formats for the input and output means can be used to input and output the information in the computer-based systems of the present invention. One format for an output means ranks the relative expression levels of different polynucleotides. Such presentation provides a skilled artisan with a ranking of relative expression levels to determine a gene expression profile.

As discussed above, the "library" of the invention also encompasses biochemical libraries of the polynucleotides of SEQ ID NOS:1–2707, e.g., collections of nucleic acids representing the provided polynucleotides. The biochemical libraries can take a variety of forms, e.g., a solution of cDNAs, a pattern of probe nucleic acids stably associated with a surface of a solid support (i.e., an array) and the like. Of particular interest are nucleic acid arrays in which one or more of SEQ ID NOS:1–2707 is represented on the array. By array is meant a an article of manufacture that has at least a substrate with at least two distinct nucleic acid targets on one of its surfaces, where the number of distinct nucleic acids can be considerably higher, typically being at least 10 nt, usually at least 20 nt and often at least 25 nt. A variety of different array formats have been developed and are known to those of skill in the art. The arrays of the subject invention find use in a variety of applications, including gene expression analysis, drug screening, mutation analysis and the like, as disclosed in the above-listed exemplary patent documents.

In addition to the above nucleic acid libraries, analogous libraries of polypeptides are also provided, where the where the polypeptides of the library will represent at least a portion of the polypeptides encoded by SEQ ID NOS: 1–2707.

Utilities

Use of Polynucleotide Probes in Mapping, and in Tissue Profiling

Polynucleotide probes, generally comprising at least 12 contiguous nt of a polynucleotide as shown in the Sequence Listing, are used for a variety of purposes, such as chromosome mapping of the polynucleotide and detection of transcription levels. Additional disclosure about preferred regions of the disclosed polynucleotide sequences is found in the Examples. A probe that hybridizes specifically to a polynucleotide disclosed herein should provide a detection signal at least 5-, 10-, or 20-fold higher than the background hybridization provided with other unrelated sequences.

Detection of Expression Levels. Nucleotide probes are used to detect expression of a gene corresponding to the provided polynucleotide. In Northern blots, mRNA is separated electrophoretically and contacted with a probe. A probe is detected as hybridizing to an mRNA species of a particular size. The amount of hybridization is quantitated to determine relative amounts of expression, for example under a particular condition. Probes are used for in situ hybridization to cells to detect expression. Probes can also be used in vivo for diagnostic detection of hybridizing sequences. Probes are typically labeled with a radioactive isotope. Other types of detectable labels can be used such as chromophores, fluors, and enzymes. Other examples of nucleotide hybridization assays are described in WO92/02526 and U.S. Pat. No. 5,124,246.

Alternatively, the Polymerase Chain Reaction (PCR) is another means for detecting small amounts of target nucleic acids (see, e.g., Mullis et al., *Meth. Enzymol.* (1987) 155: 335; U.S. Pat. No. 4,683,195; and U.S. Pat. No. 4,683,202). Two primer polynucleotides nucleotides that hybridize with the target nucleic acids are used to prime the reaction. The primers can be composed of sequence within or 3' and 5' to the polynucleotides of the Sequence Listing. Alternatively, if the primers are 3' and 5' to these polynucleotides, they need not hybridize to them or the complements. After amplification of the target with a thermostable polymerase, the amplified target nucleic acids can be detected by methods known in the art, e.g., Southern blot. mRNA or cDNA can also be detected by traditional blotting techniques (e.g., Southern blot, Northern blot, etc.) described in Sambrook et al., "Molecular Cloning: A Laboratory Manual" (New York, Cold Spring Harbor Laboratory, 1989) (e.g., without PCR amplification). In general, mRNA or cDNA generated from mRNA using a polymerase enzyme can be purified and separated using gel electrophoresis, and transferred to a solid support, such as nitrocellulose. The solid support is exposed to a labeled probe, washed to remove any unhybridized probe, and duplexes containing the labeled probe are detected.

Mapping. Polynucleotides of the present invention can be used to identify a chromosome on which the corresponding gene resides. Such mapping can be useful in identifying the function of the polynucleotide-related gene by its proximity to other genes with known function. Function can also be assigned to the polynucleotide-related gene when particular syndromes or diseases map to the same chromosome. For example, use of polynucleotide probes in identification and quantification of nucleic acid sequence aberrations is described in U.S. Pat. No. 5,783,387. An exemplary mapping method is fluorescence in situ hybridization (FISH), which facilitates comparative genomic hybridization to allow total genome assessment of changes in relative copy number of DNA sequences (see, e.g., Valdes et al, *Methods in Molecular Biology* (1997) 68:1). Polynucleotides can also be mapped to particular chromosomes using, for example, radiation hybrids or chromosome-specific hybrid panels. See Leach et al. *Advances in Genetics*, (1995) 33:63–99; Walter et al., *Nature Genetics* (1994) 7:22; Walter and Goodfellow, *Trends in Genetics* (1992) 9:352. Panels for radiation hybrid mapping are available from Research Genetics, Inc., Huntsville, Ala., USA. Databases for markers using various panels are available via the world wide web at shgc-www.stanford.edu; and www-genome.wi.mit.edu/cgi-bin/contig/rhmapper.pl. The statistical program RHMAP can be used to construct a map based on the data from radiation hybridization with a measure of the relative likelihood of one order versus another. RHMAP is available via the world wide web at http://www.sph.umich.edu/group/statgen/software. In addition, commercial programs are available for identifying regions of chromosomes commonly associated with disease, such as cancer.

Tissue Typing or Profiling. Expression of specific mRNA corresponding to the provided polynucleotides can vary in different cell types and can be tissue-specific. This variation of mRNA levels in different cell types can be exploited with nucleic acid probe assays to determine tissue types. For example, PCR, branched DNA probe assays, or blotting techniques utilizing nucleic acid probes substantially identical or complementary to polynucleotides listed in the Sequence Listing can determine the presence or absence of the corresponding cDNA or mRNA.

Tissue typing can be used to identify the developmental organ or tissue source of a metastatic lesion by identifying the expression of a particular marker of that organ or tissue. If a polynucleotide is expressed only in a specific tissue type, and a metastatic lesion is found to express that polynucleotide, then the developmental source of the lesion has been identified. Expression of a particular polynucleotide can be assayed by detection of either the corresponding mRNA or the protein product. As would be readily apparent to any forensic scientist, the sequences disclosed herein are useful in differentiating human tissue from non-human tissue. In particular, these sequences are useful to differentiate human tissue from bird, reptile, and amphibian tissue, for example.

Use of Polymorphisms. A polynucleotide of the invention can be used in forensics, genetic analysis, mapping, and diagnostic applications where the corresponding region of a gene is polymorphic in the human population. Any means for detecting a polymorphism in a gene can be used, including, but not limited to electrophoresis of protein polymorphic variants, differential sensitivity to restriction enzyme cleavage, and hybridization to allele-specific probes.

Antibody Production

Expression products of a polynucleotide of the invention, as well as the corresponding mRNA, cDNA, or complete gene, can be prepared and used for raising antibodies for experimental, diagnostic, and therapeutic purposes. For polynucleotides to which a corresponding gene has not been assigned, this provides an additional method of identifying the corresponding gene. The polynucleotide or related cDNA is expressed as described above, and antibodies are prepared. These antibodies are specific to an epitope on the polypeptide encoded by the polynucleotide, and can precipitate or bind to the corresponding native protein in a cell or tissue preparation or in a cell-free extract of an in vitro expression system.

Methods for production of antibodies that specifically bind a selected antigen are well known in the art. Immunogens for raising antibodies can be prepared by mixing a polynucleotide encoded by a polynucleotide of the invention with an adjuvant, and/or by making fusion proteins with larger immunogenic proteins. Polypeptides can also be covalently linked to other larger immunogenic proteins, such as keyhole limpet hemocyanin. Immunogens are typically administered intradermally, subcutaneously, or intramuscularly to experimental animals such as rabbits, sheep, and mice, to generate antibodies. Monoclonal antibodies can be Monoclonal antibodies can be generated by isolating spleen cells and fusing myeloma cells to form hybridomas. Alternatively, the selected polynucleotide is administered directly, such as by intramuscular injection, and expressed in vivo. The expressed protein generates a variety of protein-specific immune responses, including production of antibodies, comparable to administration of the protein.

Preparations of polyclonal and monoclonal antibodies specific for polypeptides encoded by a selected polynucleotide are made using standard methods known in the art. The antibodies specifically bind to epitopes present in the polypeptides encoded by polynucleotides disclosed in the Sequence Listing. Typically, at least 6, 8, 10, or 12 contiguous amino acids are required to form an epitope. Epitopes that involve non-contiguous amino acids may require a longer polypeptide, e.g., at least 15, 25, or 50 amino acids. Antibodies that specifically bind to human polypeptides encoded by the provided polypeptides should provide a detection signal at least 5-, 10-, or 20-fold higher than a detection signal provided with other proteins when used in Western blots or other immunochemical assays. Preferably, antibodies that specifically polypeptides of the invention do not bind to other proteins in immunochemical assays at detectable levels and can immunoprecipitate the specific polypeptide from solution.

The invention also contemplates naturally occurring antibodies specific for a polypeptide of the invention. For example, serum antibodies to a polypeptide of the invention in a human population can be purified by methods well known in the art, e.g., by passing antiserum over a column to which the corresponding selected polypeptide or fusion protein is bound. The bound antibodies can then be eluted from the column, for example using a buffer with a high salt concentration.

In addition to the antibodies discussed above, the invention also contemplates genetically engineered antibodies, antibody derivatives (e.g., single chain antibodies, antibody fragments (e.g., Fab, etc.)), according to methods well known in the art.

Polynucleotides or Arrays for Diagnostics

Polynucleotide arrays provide a high throughput technique that can assay a large number of polynucleotide sequences in a sample. This technology can be used as a diagnostic and as a tool to test for differential expression, e.g., to determine function of an encoded protein. Arrays can be created by spotting polynucleotide probes onto a substrate (e.g., glass, nitrocelllose, etc.) in a two-dimensional matrix or array having bound probes. The probes can be bound to the substrate by either covalent bonds or by non-specific interactions, such as hydrophobic interactions. Samples of polynucleotides can be detectably labeled (e.g., using radioactive or fluorescent labels) and then hybridized to the probes. Double stranded polynucleotides, comprising the labeled sample polynucleotides bound to probe polynucleotides, can be detected once the unbound portion of the sample is washed away. Techniques for constructing arrays and methods of using these arrays are described in EP 799 897; WO 97/29212; WO 97/27317; EP 785 280; WO 97/02357; U.S. Pat. No. 5,593,839; U.S. Pat. No. 5,578,832; EP 728 520; U.S. Pat. No. 5,599,695; EP 721 016; U.S. Pat. No. 5,556,752; WO 95/22058; and U.S. Pat. No. 5,631,734. Arrays can be used to, for example, examine differential expression of genes and can be used to determine gene function. For example, arrays can be used to detect differential expression of a polynucleotide between a test cell and control cell (e.g., cancer cells and normal cells). For example, high expression of a particular message in a cancer cell, which is not observed in a corresponding normal cell, can indicate a cancer specific gene product. Exemplary uses of arrays are further described in, for example, Pappalarado et al., Sem. Radiation Oncol. (1998) 8:217; and Ramsay Nature Biotechnol. (1998) 16:40.

Differential Expression in Diagnosis

The polynucleotides of the invention can also be used to detect differences in expression levels between two cells, e.g., as a method to identify abnormal or diseased tissue in a human. For polynucleotides corresponding to profiles of protein families, the choice of tissue can be selected according to the putative biological function. In general, the expression of a gene corresponding to a specific polynucleotide is compared between a first tissue that is suspected of being diseased and a second, normal tissue of the human. The tissue suspected of being abnormal or diseased can be derived from a different tissue type of the human, but preferably it is derived from the same tissue type; for example an intestinal polyp or other abnormal growth should be compared with normal intestinal tissue. The normal tissue can be the same tissue as that of the test sample, or any normal tissue of the patient, especially those that express the polynucleotide-related gene of interest (e.g., brain, thymus, testis, heart, prostate, placenta, spleen, small intestine, skeletal muscle, pancreas, and the mucosal lining of the colon). A difference between the polynucleotide-related gene, mRNA, or protein in the two tissues which are compared, for example in molecular weight, amino acid or nucleotide sequence, or relative abundance, indicates a change in the gene, or a gene which regulates it, in the tissue of the human that was suspected of being diseased. Examples of detection of differential expression and its use in diagnosis of cancer are described in U.S. Pat. Nos. 5,688,641 and 5,677,125.

A genetic predisposition to disease in a human can also be detected by comparing expression levels of an mRNA or protein corresponding to a polynucleotide of the invention in a fetal tissue with levels associated in normal fetal tissue. Fetal tissues that are used for this purpose include, but are not limited to, amniotic fluid, chorionic villi, blood, and the blastomere of an in vitro-fertilized embryo. The comparable normal polynucleotide-related gene is obtained from any tissue. The mRNA or protein is obtained from a normal tissue of a human in which the polynucleotide-related gene is expressed. Differences such as alterations in the nucleotide sequence or size of the same product of the fetal polynucleotide-related gene or mRNA, or alterations in the molecular weight, amino acid sequence, or relative abundance of fetal protein, can indicate a germline mutation in the polynucleotide-related gene of the fetus, which indicates a genetic predisposition to disease. In general, diagnostic, prognostic, and other methods of the invention based on differential expression involve detection of a level or amount of a gene product, particularly a differentially expressed gene product, in a test sample obtained from a patient suspected of having or being susceptible to a disease (e.g., breast cancer, lung cancer, colon cancer and/or metastatic forms thereof), and comparing the detected levels to those levels found in normal cells (e.g., cells substantially unaffected by cancer) and/or other control cells (e.g., to differentiate a cancerous cell from a cell affected by dysplasia). Furthermore, the severity of the disease can be assessed by comparing the detected levels of a differentially expressed gene product with those levels detected in samples representing the levels of differentially gene product associated with varying degrees of severity of disease. It should be noted that use of the term "diagnostic" herein is not necessarily meant to exclude "prognostic" or "prognosis," but rather is used as a matter of convenience.

The term "differentially expressed gene" is generally intended to encompass a polynucleotide that can, for example, include an open reading frame encoding a gene product (e.g., a polypeptide), and/or introns of such genes and adjacent 5' and 3' non-coding nucleotide sequences involved in the regulation of expression, up to about 20 kb beyond the coding region, but possibly further in either direction. The gene can be introduced into an appropriate vector for extrachromosomal maintenance or for integration into a host genome. In general, a difference in expression level associated with a decrease in expression level of at least about 25%, usually at least about 50% to 75%, more usually at least about 90% or more is indicative of a differentially expressed gene of interest, i.e., a gene that is underexpressed or down-regulated in the test sample relative to a control sample. Furthermore, a difference in expression level associated with an increase in expression of at least about 25%, usually at least about 50% to 75%, more usually at least about 90% and can be at least about 1½-fold, usually at least about 2-fold to about 10-fold, and can be about 100-fold to about 1,000-fold increase relative to a control sample is indicative of a differentially expressed gene of interest, i.e., an overexpressed or up-regulated gene.

"Differentially expressed polynucleotide" as used herein means a nucleic acid molecule (RNA or DNA) comprising a sequence that represents a differentially expressed gene, e.g., the differentially expressed polynucleotide comprises a sequence (e.g., an open reading frame encoding a gene product) that uniquely identifies a differentially expressed gene so that detection of the differentially expressed polynucleotide in a sample is correlated with the presence of a differentially expressed gene in a sample. "Differentially expressed polynucleotides" is also meant to encompass fragments of the disclosed polynucleotides, e.g., fragments retaining biological activity, as well as nucleic acids homologous, substantially similar, or substantially identical (e.g., having about 90% sequence identity) to the disclosed polynucleotides.

"Diagnosis" as used herein generally includes determination of a subject's susceptibility to a disease or disorder, determination as to whether a subject is presently affected by a disease or disorder, as well as to the prognosis of a subject affected by a disease or disorder (e.g., identification of pre-metastatic or metastatic cancerous states, stages of cancer, or responsiveness of cancer to therapy). The present invention particularly encompasses diagnosis of subjects in the context of breast cancer (e.g., carcinoma in situ (e.g., ductal carcinoma in situ), estrogen receptor (ER)-positive breast cancer, ER-negative breast cancer, or other forms and/or stages of breast cancer), lung cancer (e.g., small cell carcinoma, non-small cell carcinoma, mesothelioma, and other forms and/or stages of lung cancer), and colon cancer (e.g., adenomatous polyp, colorectal carcinoma, and other forms and/or stages of colon cancer).

"Sample" or "biological sample" as used throughout here are generally meant to refer to samples of biological fluids or tissues, particularly samples obtained from tissues, especially from cells of the type associated with the disease for which the diagnostic application is designed (e.g., ductal adenocarcinoma), and the like. "Samples" is also meant to encompass derivatives and fractions of such samples (e.g., cell lysates). Where the sample is solid tissue, the cells of the tissue can be dissociated or tissue sections can be analyzed.

Methods of the subject invention useful in diagnosis or prognosis typically involve comparison of the abundance of a selected differentially expressed gene product in a sample of interest with that of a control to determine any relative differences in the expression of the gene product, where the difference can be measured qualitatively and/or quantitatively. Quantitation can be accomplished, for example, by comparing the level of expression product detected in the sample with the amounts of product present in a standard curve. A comparison can be made visually; by using a technique such as densitometry, with or without computerized assistance; by preparing a representative library of cDNA clones of mRNA isolated from a test sample, sequencing the clones in the library to determine that number of cDNA clones corresponding to the same gene product, and analyzing the number of clones corresponding to that same gene product relative to the number of clones of the same gene product in a control sample; or by using an array to detect relative levels of hybridization to a selected sequence or set of sequences, and comparing the hybridization pattern to that of a control. The differences in expression are then correlated with the presence or absence of an abnormal expression pattern. A variety of different methods for determining the nucleic acid abundance in a sample are known to those of skill in the art (see, e.g., WO 97/27317). In general, diagnostic assays of the invention involve detection of a gene product of a the polynucleotide sequence (e.g., mRNA or polypeptide) that corresponds to a sequence of SEQ ID NOS:1–2707. The patient from whom the sample is obtained can be apparently healthy, susceptible to disease (e.g., as determined by family history or exposure to certain environmental factors), or can already be identified as having a condition in which altered expression of a gene product of the invention is implicated.

Diagnosis can be determined based on detected gene product expression levels of a gene product encoded by at least one, preferably at least two or more, at least 3 or more, or at least 4 or more of the polynucleotides having a sequence set forth in SEQ ID NOS:1–2707, and can involve detection of expression of genes corresponding to all of SEQ ID NOS:1–2707 and/or additional sequences that can serve as additional diagnostic markers and/or reference sequences. Where the diagnostic method is designed to detect the presence or susceptibility of a patient to cancer, the assay preferably involves detection of a gene product encoded by a gene corresponding to a polynucleotide that is differentially expressed in cancer. Examples of such differentially expressed polynucleotides are described in the Examples below. Given the provided polynucleotides and information regarding their relative expression levels provided herein, assays using such polynucleotides and detection of their expression levels in diagnosis and prognosis will be readily apparent to the ordinarily skilled artisan.

Any of a variety of detectable labels can be used in connection with the various embodiments of the diagnostic methods of the invention. Suitable detectable labels include fluorochromes, (e.g. fluorescein isothiocyanate (FITC), rhodamine, Texas Red, phycoerythrin, allophycocyanin, 6-carboxyfluorescein (6-FAM), 2',7'-dimethoxy-4',5'-dichloro-6-carboxyfluorescein, 6-carboxy-X-rhodamine (ROX), 6-carboxy-2',4',7',4,7-hexachlorofluorescein (HEX), 5-carboxyfluorescein (5-FAM) or N,N,N',N'-tetramethyl-6-carboxyrhodamine (TAMRA)), radioactive labels, (e.g. $^{32}$P, $^{35}$S, $^{3}$H, etc.), and the like. The detectable label can involve a two stage systems (e.g., biotin-avidin, hapten-anti-hapten antibody, etc.)

Reagents specific for the polynucleotides and polypeptides of the invention, such as antibodies and nucleotide probes, can be supplied in a kit for detecting the presence of an expression product in a biological sample. The kit can also contain buffers or labeling components, as well as instructions for using the reagents to detect and quantify expression products in the biological sample. Exemplary embodiments of the diagnostic methods of the invention are described below in more detail.

Polypeptide detection in diagnosis. In one embodiment, the test sample is assayed for the level of a differentially expressed polypeptide. Diagnosis can be accomplished using any of a number of methods to determine the absence or presence or altered amounts of the differentially expressed polypeptide in the test sample. For example, detection can utilize staining of cells or histological sections with labeled antibodies, performed in accordance with conventional methods. Cells can be permeabilized to stain cytoplasmic molecules. In general, antibodies that specifically bind a differentially expressed polypeptide of the invention are added to a sample, and incubated for a period of time sufficient to allow binding to the epitope, usually at least about 10 minutes. The antibody can be detectably labeled for direct detection (e.g., using radioisotopes, enzymes, fluorescers, chemiluminescers, and the like), or can be used in conjunction with a second stage antibody or reagent to detect binding (e.g., biotin with horseradish peroxidase-conjugated avidin, a secondary antibody conjugated to a fluorescent compound, e.g. fluorescein, rhodamine, Texas red, etc.). The absence or presence of antibody binding can be determined by various methods, including flow cytometry of dissociated cells, microscopy, radiography, scintillation counting, etc. Any suitable alternative methods can of qualitative or quantitative detection of levels or amounts of differentially expressed polypeptide can be used, for example ELISA, western blot, immunoprecipitation, radioimmunoassay, etc.

mRNA detection. The diagnostic methods of the invention can also or alternatively involve detection of mRNA encoded by a gene corresponding to a differentially expressed polynucleotides of the invention. Any suitable qualitative or quantitative methods known in the art for detecting specific mRNAs can be used. mRNA can be detected by, for example, in situ hybridization in tissue sections, by reverse transcriptase-PCR, or in Northern blots containing poly A+ mRNA. One of skill in the art can readily use these methods to determine differences in the size or amount of mRNA transcripts between two samples. mRNA expression levels in a sample can also be determined by generation of a library of expressed sequence tags (ESTs) from the sample, where the EST library is representative of sequences present in the sample (Adams, et al., (1991) *Science* 252:1651). Enumeration of the relative representation of ESTs within the library can be used to approximate the relative representation of the gene transcript within the starting sample. The results of EST analysis of a test sample can then be compared to EST analysis of a reference sample to determine the relative expression levels of a selected polynucleotide, particularly a polynucleotide corresponding to one or more of the differentially expressed genes described herein. Alternatively, gene expression in a test sample can be performed using serial analysis of gene expression (SAGE) methodology (e.g., Velculescu et al., *Science* (1995) 270:484) or differential display (DD) methodology (see, e.g., U.S. Pat. No. 5,776,683; and U.S. Pat. No. 5,807,680).

Alternatively, gene expression can be analyzed using hybridization analysis. Oligonucleotides or cDNA can be used to selectively identify or capture DNA or RNA of specific sequence composition, and the amount of RNA or cDNA hybridized to a known capture sequence determined qualitatively or quantitatively, to provide information about the relative representation of a particular message within the pool of cellular messages in a sample. Hybridization analysis can be designed to allow for concurrent screening of the relative expression of hundreds to thousands of genes by using, for example, array-based technologies having high density formats, including filters, microscope slides, or microchips, or solution-based technologies that use spectroscopic analysis (e.g., mass spectrometry). One exemplary use of arrays in the diagnostic methods of the invention is described below in more detail.

Use of a single gene in diagnostic applications. The diagnostic methods of the invention can focus on the expression of a single differentially expressed gene. For example, the diagnostic method can involve detecting a differentially expressed gene, or a polymorphism of such a gene (e.g., a polymorphism in an coding region or control region), that is associated with disease. Disease-associated polymorphisms can include deletion or truncation of the gene, mutations that alter expression level and/or affect activity of the encoded protein, etc.

A number of methods are available for analyzing nucleic acids for the presence of a specific sequence, e.g. a disease associated polymorphism. Where large amounts of DNA are available, genomic DNA is used directly. Alternatively, the region of interest is cloned into a suitable vector and grown in sufficient quantity for analysis. Cells that express a differentially expressed genean be used as a source of mRNA, which can be assayed directly or reverse transcribed into cDNA for analysis. The nucleic acid can be amplified by conventional techniques, such as the polymerase chain reaction (PCR), to provide sufficient amounts for analysis, and a detectable label can be included in the amplification reaction (e.g., using a detectably labeled primer or detectably labeled oligonucleotides) to facilitate detection. Alternatively, various methods are also known in the art that utilize oligonucleotide ligation as a means of detecting polymorphisms, see e.g., Riley et al., *Nucl. Acids Res.* (1990) 18:2887; and Delahunty et al., *Am. J. Hum. Genet.* (1996) 58:1239.

The amplified or cloned sample nucleic acid can be analyzed by one of a number of methods known in the art. The nucleic acid can be sequenced by dideoxy or other methods, and the sequence of bases compared to a selected sequence, e.g., to a wild-type sequence. Hybridization with the polymorphic or variant sequence can also be used to determine its presence in a sample (e.g., by Southern blot, dot blot, etc.). The hybridization pattern of a polymorphic or variant sequence and a control sequence to an array of oligonucleotide probes immobilized on a solid support, as described in U.S. Pat. No. 5,445,934, or in WO 95/35505, can also be used as a means of identifying polymorphic or variant sequences associated with disease. Single strand conformational polymorphism (SSCP) analysis, denaturing gradient gel electrophoresis (DGGE), and heteroduplex analysis in gel matrices are used to detect conformational changes created by DNA sequence variation as alterations in electrophoretic mobility. Alternatively, where a polymorphism creates or destroys a recognition site for a restriction endonuclease, the sample is digested with that endonuclease, and the products size fractionated to determine whether the fragment was digested. Fractionation is performed by gel or capillary electrophoresis, particularly acrylamide or agarose gels.

Screening for mutations in a gene can be based on the functional or antigenic characteristics of the protein. Protein truncation assays are useful in detecting deletions that can affect the biological activity of the protein. Various immunoassays designed to detect polymorphisms in proteins can be used in screening. Where many diverse genetic mutations lead to a particular disease phenotype, functional protein assays have proven to be effective screening tools. The activity of the encoded protein can be determined by comparison with the wild-type protein.

Pattern matching in diagnosis using arrays. In another embodiment, the diagnostic and/or prognostic methods of the invention involve detection of expression of a selected set of genes in a test sample to produce a test expression pattern (TEP). The TEP is compared to a reference expression pattern (REP), which is generated by detection of expression of the selected set of genes in a reference sample (e.g., a positive or negative control sample). The selected set of genes includes at least one of the genes of the invention, which genes correspond to the polynucleotide sequences of SEQ ID NOS:1–2707. Of particular interest is a selected set of genes that includes gene differentially expressed in the disease for which the test sample is to be screened.

"Reference sequences" or "reference polynucleotides" as used herein in the context of differential gene expression analysis and diagnosis/prognosis refers to a selected set of polynucleotides, which selected set includes at least one or more of the differentially expressed polynucleotides described herein. A plurality of reference sequences, preferably comprising positive and negative control sequences, can be included as reference sequences. Additional suitable reference sequences are found in GenBank, Unigene, and other nucleotide sequence databases (including, e.g., expressed sequence tag (EST), partial, and full-length sequences).

"Reference array" means an array having reference sequences for use in hybridization with a sample, where the reference sequences include all, at least one of, or any subset of the differentially expressed polynucleotides described herein. Usually such an array will include at least 3 different reference sequences, and can include any one or all of the provided differentially expressed sequences. Arrays of interest can further comprise sequences, including polymorphisms, of other genetic sequences, particularly other sequences of interest for screening for a disease or disorder (e.g., cancer, dysplasia, or other related or unrelated diseases, disorders, or conditions). The oligonucleotide sequence on the array will usually be at least about 12 nt in length, and can be of about the length of the provided sequences, or can extend into the flanking regions to generate fragments of 100 nt to 200 nt in length or more. Reference arrays can be produced according to any suitable methods known in the art. For example, methods of producing large arrays of oligonucleotides are described in U.S. Pat. No. 5,134,854, and U.S. Pat. No. 5,445,934 using light-directed synthesis techniques. Using a computer controlled system, a heterogeneous array of monomers is converted, through simultaneous coupling at a number of reaction sites, into a heterogeneous array of polymers.

Alternatively, microarrays are generated by deposition of pre-synthesized oligonucleotides onto a solid substrate, for example as described in PCT published application no. WO 95/35505.

A "reference expression pattern" or "REP" as used herein refers to the relative levels of expression of a selected set of genes, particularly of differentially expressed genes, that is associated with a selected cell type, e.g., a normal cell, a cancerous cell, a cell exposed to an environmental stimulus, and the like. A "test expression pattern" or "TEP" refers to relative levels of expression of a selected set of genes, particularly of differentially expressed genes, in a test sample (e.g., a cell of unknown or suspected disease state, from which mRNA is isolated).

REPs can be generated in a variety of ways according to methods well known in the art. For example, REPs can be generated by hybridizing a control sample to an array having a selected set of polynucleotides (particularly a selected set of differentially expressed polynucleotides), acquiring the hybridization data from the array, and storing the data in a format that allows for ready comparison of the REP with a TEP. Alternatively, all expressed sequences in a control sample can be isolated and sequenced, e.g., by isolating mRNA from a control sample, converting the mRNA into cDNA, and sequencing the cDNA. The resulting sequence information roughly or precisely reflects the identity and relative number of expressed sequences in the sample. The sequence information can then be stored in a format (e.g., a computer-readable format) that allows for ready comparison of the REP with a TEP. The REP can be normalized prior to or after data storage, and/or can be processed to selectively remove sequences of expressed genes that are of less interest or that might complicate analysis (e.g., some or all of the sequences associated with housekeeping genes can be eliminated from REP data).

TEPs can be generated in a manner similar to REPs, e.g., by hybridizing a test sample to an array having a selected set of polynucleotides, particularly a selected set of differentially expressed polynucleotides, acquiring the hybridization data from the array, and storing the data in a format that allows for ready comparison of the TEP with a REP. The REP and TEP to be used in a comparison can be generated simultaneously, or the TEP can be compared to previously generated and stored REPs.

In one embodiment of the invention, comparison of a TEP with a REP involves hybridizing a test sample with a reference array, where the reference array has one or more reference sequences for use in hybridization with a sample. The reference sequences include all, at least one of, or any subset of the differentially expressed polynucleotides described herein. Hybridization data for the test sample is acquired, the data normalized, and the produced TEP compared with a REP generated using an array having the same or similar selected set of differentially expressed polynucleotides. Probes that correspond to sequences differentially expressed between the two samples will show decreased or increased hybridization efficiency for one of the samples relative to the other.

Methods for collection of data from hybridization of samples with a reference arrays are well known in the art. For example, the polynucleotides of the reference and test samples can be generated using a detectable fluorescent label, and hybridization of the polynucleotides in the samples detected by scanning the microarrays for the presence of the detectable label using, for example, a microscope and light source for directing light at a substrate. A photon counter detects fluorescence from the substrate, while an x-y translation stage varies the location of the substrate. A confocal detection device that can be used in the subject methods is described in U.S. Pat. No. 5,631,734. A scanning laser microscope is described in Shalon et al., *Genome Res.* (1996) 6:639. A scan, using the appropriate excitation line, is performed for each fluorophore used. The digital images generated from the scan are then combined for subsequent analysis. For any particular array element, the ratio of the fluorescent signal from one sample (e.g., a test sample) is compared to the fluorescent signal from another sample (e.g., a reference sample), and the relative signal intensity determined.

Methods for analyzing the data collected from hybridization to arrays are well known in the art. For example, where detection of hybridization involves a fluorescent label, data analysis can include the steps of determining fluorescent intensity as a function of substrate position from the data collected, removing outliers, i.e. data deviating from a predetermined statistical distribution, and calculating the relative binding affinity of the targets from the remaining data. The resulting data can be displayed as an image with the intensity in each region varying according to the binding affinity between targets and probes.

In general, the test sample is classified as having a gene expression profile corresponding to that associated with a disease or non-disease state by comparing the TEP generated from the test sample to one or more REPs generated from reference samples (e.g., from samples associated with cancer or specific stages of cancer, dysplasia, samples affected by a disease other than cancer, normal samples, etc.). The criteria for a match or a substantial match between a TEP and a REP include expression of the same or substantially the same set of reference genes, as well as expression of these reference genes at substantially the same levels (e.g., no significant difference between the samples for a signal associated with a selected reference sequence after normalization of the samples, or at least no greater than about 25% to about 40% difference in signal strength for a given reference sequence. In general, a pattern match between a TEP and a REP includes a match in expression, preferably a match in qualitative or quantitative expression level, of at least one of, all or any subset of the differentially expressed genes of the invention.

Pattern matching can be performed manually, or can be performed using a computer program. Methods for preparation of substrate matrices (e.g., arrays), design of oligonucleotides for use with such matrices, labeling of probes, hybridization conditions, scanning of hybridized matrices, and analysis of patterns generated, including comparison analysis, are described in, for example, U.S. Pat. No. 5,800, 992.

Diagnosis Prognosis and Management of Cancer

The polynucleotides of the invention and their gene products are of particular interest as genetic or biochemical markers (e.g., in blood or tissues) that will detect the earliest changes along the carcinogenesis pathway and/or to monitor the efficacy of various therapies and preventive interventions. For example, the level of expression of certain polynucleotides can be indicative of a poorer prognosis, and therefore warrant more aggressive chemo- or radio-therapy for a patient or vice versa. The correlation of novel surrogate tumor specific features with response to treatment and outcome in patients can define prognostic indicators that allow the design of tailored therapy based on the molecular profile of the tumor. These therapies include antibody targeting and gene therapy. Determining expression of certain polynucleotides and comparison of a patients profile with known expression in normal tissue and variants of the disease allows a determination of the best possible treatment for a patient, both in terms of specificity of treatment and in terms of comfort level of the patient. Surrogate tumor markers, such as polynucleotide expression, can also be used to better classify, and thus diagnose and treat, different forms and disease states of cancer. Two classifications widely used in oncology that can benefit from identification of the expression levels of the polynucleotides of the invention are staging of the cancerous disorder, and grading the nature of the cancerous tissue.

The polynucleotides of the invention can be useful to monitor patients having or susceptible to cancer to detect potentially malignant events at a molecular level before they are detectable at a gross morphological level. Furthermore, a polynucleotide of the invention identified as important for one type of cancer can also have implications for development or risk of development of other types of cancer, e.g., where a polynucleotide is differentially expressed across various cancer types. Thus, for example, expression of a polynucleotide that has clinical implications for metastatic colon cancer can also have clinical implications for stomach cancer or endometrial cancer.

Staging. Staging is a process used by physicians to describe how advanced the cancerous state is in a patient. Staging assists the physician in determining a prognosis, planning treatment and evaluating the results of such treatment. Staging systems vary with the types of cancer, but generally involve the following "TNM" system: the type of tumor, indicated by T; whether the cancer has metastasized to nearby lymph nodes, indicated by N; and whether the cancer has metastasized to more distant parts of the body, indicated by M. Generally, if a cancer is only detectable in the area of the primary lesion without having spread to any lymph nodes it is called Stage I. If it has spread only to the closest lymph nodes, it is called Stage II. In Stage III, the cancer has generally spread to the lymph nodes in near proximity to the site of the primary lesion. Cancers that have spread to a distant part of the body, such as the liver, bone, brain or other site, are Stage IV, the most advanced stage.

The polynucleotides of the invention can facilitate fine-tuning of the staging process by identifying markers for the aggresivity of a cancer, e.g. the metastatic potential, as well as the presence in different areas of the body. Thus, a Stage II cancer with a polynucleotide signifying a high metastatic potential cancer can be used to change a borderline Stage II tumor to a Stage III tumor, justifying more aggressive therapy. Conversely, the presence of a polynucleotide signifying a lower metastatic potential allows more conservative staging of a tumor.

Grading of cancers. Grade is a term used to describe how closely a tumor resembles normal tissue of its same type. The microscopic appearance of a tumor is used to identify tumor grade based on parameters such as cell morphology, cellular organization, and other markers of differentiation. As a general rule, the grade of a tumor corresponds to its rate of growth or aggressiveness, with undifferentiated or high-grade tumors being more aggressive than well differentiated or low-grade tumors. The following guidelines are generally used for grading tumors: 1) GX Grade cannot be assessed; 2) G1 Well differentiated; G2 Moderately well differentiated; 3) G3 Poorly differentiated; 4) G4 Undifferentiated. The polynucleotides of the invention can be especially valuable in determining the grade of the tumor, as they not only can aid in determining the differentiation status of the cells of a tumor, they can also identify factors other than differentiation that are valuable in determining the aggressiveness of a tumor, such as metastatic potential.

Detection of lung cancer. The polynucleotides of the invention can be used to detect lung cancer in a subject. Although there are more than a dozen different kinds of lung cancer, the two main types of lung cancer are small cell and nonsmall cell, which encompass about 90% of all lung cancer cases. Small cell carcinoma (also called oat cell carcinoma) usually starts in one of the larger bronchial tubes, grows fairly rapidly, and is likely to be large by the time of diagnosis. Nonsmall cell lung cancer (NSCLC) is made up of three general subtypes of lung cancer. Epidermoid carcinoma (also called squamous cell carcinoma) usually starts in one of the larger bronchial tubes and grows relatively slowly. The size of these tumors can range from very small to quite large. Adenocarcinoma starts growing near the outside surface of the lung and can vary in both size and growth rate. Some slowly growing adenocarcinomas are described as alveolar cell cancer. Large cell carcinoma starts near the surface of the lung, grows rapidly, and the growth is usually fairly large when diagnosed. Other less common forms of lung cancer are carcinoid, cylindroma, mucoepidermoid, and malignant mesothelioma.

The polynucleotides of the invention, e.g., polynucleotides differentially expressed in normal cells versus cancerous lung cells (e.g., tumor cells of high or low metastatic potential) or between types of cancerous lung cells (e.g., high metastatic versus low metastatic), can be used to distinguish types of lung cancer as well as identifying traits specific to a certain patient's cancer and selecting an appropriate therapy. For example, if the patient's biopsy expresses a polynucleotide that is associated with a low metastatic potential, it may justify leaving a larger portion of the patient's lung in surgery to remove the lesion. Alternatively, a smaller lesion with expression of a polynucleotide that is associated with high metastatic potential may justify a more radical removal of lung tissue and/or the surrounding lymph nodes, even if no metastasis can be identified through pathological examination.

Detection of breast cancer. The majority of breast cancers are adenocarcinomas subtypes, which can be summarized as follows: 1) ductal carcinoma in situ (DCIS), including comedocarcinoma; 2) infiltrating (or invasive) ductal carcinoma (IDC); 3) lobular carcinoma in situ (LCIS); 4) infiltrating (or invasive) lobular carcinoma (ILC); 5) inflammatory breast cancer; 6) medullary carcinoma; 7) mucinous carcinoma; 8) Paget's disease of the nipple; 9) Phyllodes tumor; and 10) tubular carcinoma;

The expression of polynucleotides of the invention can be used in the diagnosis and management of breast cancer, as well as to distinguish between types of breast cancer. Detection of breast cancer can be determined using expression levels of any of the appropriate polynucleotides of the invention, either alone or in combination. Determination of the aggressive nature and/or the metastatic potential of a breast cancer can also be determined by comparing levels of one or more polynucleotides of the invention and comparing levels of another sequence known to vary in cancerous tissue, e.g. ER expression. In addition, development of breast cancer can be detected by examining the ratio of expression of a differentially expressed polynucleotide to the levels of steroid hormones (e.g., testosterone or estrogen) or to other hormones (e.g., growth hormone, insulin). Thus expression of specific marker polynucleotides can be used to discriminate between normal and cancerous breast tissue, to discriminate between breast cancers with different cells of origin, to discriminate between breast cancers with different potential metastatic rates, etc.

Detection of colon cancer. The polynucleotides of the invention exhibiting the appropriate expression pattern can be used to detect colon cancer in a subject. Colorectal cancer is one of the most common neoplasms in humans and perhaps the most frequent form of hereditary neoplasia. Prevention and early detection are key factors in controlling and curing colorectal cancer. Colorectal cancer begins as polyps, which are small, benign growths of cells that form on the inner lining of the colon. Over a period of several years, some of these polyps accumulate additional mutations and become cancerous. Multiple familial colorectal cancer disorders have been identified, which are summarized as follows: 1) Familial adenomatous polyposis (FAP); 2) Gardner's syndrome; 3) Hereditary nonpolyposis colon cancer (HNPCC); and 4) Familial colorectal cancer in Ashkenazi Jews. The expression of appropriate polynucleotides of the invention can be used in the diagnosis, prognosis and management of colorectal cancer. Detection of colon cancer can be determined using expression levels of any of these sequences alone or in combination with the levels of expression. Determination of the aggressive nature and/or the metastatic potential of a colon cancer can be determined by comparing levels of one or more polynucleotides of the invention and comparing total levels of another sequence known to vary in cancerous tissue, e.g., expression of p53, DCC ras, lor FAP (see, e.g., Fearon E R, et al., *Cell* (1990) 61(5):759; Hamilton S R et al., *Cancer* (1993) 72:957; Bodmer W, et al., *Nat Genet.* (1994) 4(3):217; Fearon E R, *Ann N Y Acad Sci.* (1995) 768:101). For example, development of colon cancer can be detected by examining the ratio of any of the polynucleotides of the invention to the levels of oncogenes (e.g. ras) or tumor suppressor genes (e.g. FAP or p53). Thus expression of specific marker polynucleotides can be used to discriminate between normal and cancerous colon tissue, to discriminate between colon cancers with different cells of origin, to discriminate between colon cancers with different potential metastatic rates, etc.

Use of Polynucleotides to Screen for Peptide Analogs and Antagonists

Polypeptides encoded by the instant polynucleotides and corresponding full length genes can be used to screen peptide libraries to identify binding partners, such as receptors, from among the encoded polypeptides. Peptide libraries can be synthesized according to methods known in the art (see, e.g., U.S. Pat. No. 5,010,175, and WO 91/17823). Agonists or antagonists of the polypeptides if the invention can be screened using any available method known in the art, such as signal transduction, antibody binding, receptor binding, mitogenic assays, chemotaxis assays, etc. The assay conditions ideally should resemble the conditions under which the native activity is exhibited in vivo, that is, under physiologic pH, temperature, and ionic strength. Suitable agonists or antagonists will exhibit strong inhibition or enhancement of the native activity at concentrations that do not cause toxic side effects in the subject. Agonists or antagonists that compete for binding to the native polypeptide can require concentrations equal to or greater than the native concentration, while inhibitors capable of binding irreversibly to the polypeptide can be added in concentrations on the order of the native concentration.

Such screening and experimentation can lead to identification of a novel polypeptide binding partner, such as a receptor, encoded by a gene or a cDNA corresponding to a polynucleotide of the invention, and at least one peptide agonist or antagonist of the novel binding partner. Such agonists and antagonists can be used to modulate, enhance, or inhibit receptor function in cells to which the receptor is native, or in cells that possess the receptor as a result of genetic engineering. Further, if the novel receptor shares biologically important characteristics with a known receptor, information about agonist/antagonist binding can facilitate development of improved agonists/antagonists of the known receptor.

Pharmaceutical Compositions and Therapeutic Uses

Pharmaceutical compositions of the invention can comprise polypeptides, antibodies, or polynucleotides (including antisense nucleotides and ribozymes) of the claimed invention in a therapeutically effective amount. The term "therapeutically effective amount" as used herein refers to an amount of a therapeutic agent to treat, ameliorate, or prevent a desired disease or condition, or to exhibit a detectable therapeutic or preventative effect. The effect can be detected by, for example, chemical markers or antigen levels. Therapeutic effects also include reduction in physical symptoms, such as decreased body temperature. The precise effective amount for a subject will depend upon the subject's size and health, the nature and extent of the condition, and the therapeutics or combination of therapeutics selected for administration. Thus, it is not useful to specify an exact effective amount in advance. However, the effective amount for a given situation is determined by routine experimentation and is within the judgment of the clinician. For purposes of the present invention, an effective dose will generally be from about 0.01 mg/kg to 50 mg/kg or 0.05 mg/kg to about 10 mg/kg of the DNA constructs in the individual to which it is administered.

A pharmaceutical composition can also contain a pharmaceutically acceptable carrier. The term "pharmaceutically acceptable carrier" refers to a carrier for administration of a therapeutic agent, such as antibodies or a polypeptide, genes, and other therapeutic agents. The term refers to any pharmaceutical carrier that does not itself induce the production of antibodies harmful to the individual receiving the composition, and which can be administered without undue toxicity. Suitable carriers can be large, slowly metabolized macromolecules such as proteins, polysaccharides, polylactic acids, polyglycolic acids, polymeric amino acids, amino acid copolymers, and inactive virus particles. Such carriers are well known to those of ordinary skill in the art. Pharmaceutically acceptable carriers in therapeutic compositions can include liquids such as water, saline, glycerol and ethanol. Auxiliary substances, such as wetting or emulsifying agents, pH buffering substances, and the like, can also be present in such vehicles. Typically, the therapeutic compositions are prepared as injectables, either as liquid solutions or suspensions; solid forms suitable for solution in, or suspension in, liquid vehicles prior to injection can also be prepared. Liposomes are included within the definition of a pharmaceutically acceptable carrier. Pharmaceutically acceptable salts can also be present in the pharmaceutical composition, e.g., mineral acid salts such as hydrochlorides, hydrobromides, phosphates, sulfates, and the like; and the salts of organic acids such as acetates, propionates, malonates, benzoates, and the like. A thorough discussion of pharmaceutically acceptable excipients is available in *Remington's Pharmaceutical Sciences* (Mack Pub. Co., N.J. 1991).

Delivery Methods. Once formulated, the compositions of the invention can be (1) administered directly to the subject (e.g., as polynucleotide or polypeptides); or (2) delivered ex vivo, to cells derived from the subject (e.g., as in ex vivo gene therapy). Direct delivery of the compositions will generally be accomplished by parenteral injection, e.g., subcutaneously, intraperitoneally, intravenously or intramuscularly, intratumoral or to the interstitial space of a tissue. Other modes of administration include oral and pulmonary administration, suppositories, and transdermal applications, needles, and gene guns or hyposprays. Dosage treatment can be a single dose schedule or a multiple dose schedule.

Methods for the ex vivo delivery and reimplantation of transformed cells into a subject are known in the art and described in e.g., International Publication No. WO 93/14778. Examples of cells useful in ex vivo applications include, for example, stem cells, particularly hematopoetic, lymph cells, macrophages, dendritic cells, or tumor cells. Generally, delivery of nucleic acids for both ex vivo and in vitro applications can be accomplished by, for example, dextran-mediated transfection, calcium phosphate precipitation, polybrene mediated transfection, protoplast fusion, electroporation, encapsulation of the polynucleotide(s) in liposomes, and direct microinjection of the DNA into nuclei, all well known in the art.

Once a gene corresponding to a polynucleotide of the invention has been found to correlate with a proliferative disorder, such as neoplasia, dysplasia, and hyperplasia, the disorder can be amenable to treatment by administration of a therapeutic agent based on the provided polynucleotide, corresponding polypeptide or other corresponding molecule (e.g., antisense, ribozyme, etc.).

The dose and the means of administration of the inventive pharmaceutical compositions are determined based on the specific qualities of the therapeutic composition, the condition, age, and weight of the patient, the progression of the disease, and other relevant factors. For example, administration of polynucleotide therapeutic compositions agents of the invention includes local or systemic administration, including injection, oral administration, particle gun or catheterized administration, and topical administration. Preferably, the therapeutic polynucleotide composition contains an expression construct comprising a promoter operably linked to a polynucleotide of at least 12, 22, 25, 30, or 35 contiguous nt of the polynucleotide disclosed herein. Various methods can be used to administer the therapeutic composition directly to a specific site in the body. For example, a small metastatic lesion is located and the therapeutic composition injected several times in several different locations within the body of tumor. Alternatively, arteries which serve a tumor are identified, and the therapeutic composition injected into such an artery, in order to deliver the composition directly into the tumor. A tumor that has a necrotic center is aspirated and the composition injected directly into the now empty center of the tumor. The antisense composition is directly administered to the surface of the tumor, for example, by topical application of the composition. X-ray imaging is used to assist in certain of the above delivery methods.

Receptor-mediated targeted delivery of therapeutic compositions containing an antisense polynucleotide, subgenomic polynucleotides, or antibodies to specific tissues can also be used. Receptor-mediated DNA delivery techniques are described in, for example, Findeis et al., *Trends Biotechnol.* (1993) 11:202; Chiou et al., *Gene Therapeutics: Methods And Applications Of Direct Gene Transfer* (J. A. Wolff, ed.) (1994); Wu et al., *J. Biol. Chem.* (1988) 263:621; Wu et al., *J. Biol. Chem.* (1994) 269:542; Zenke et al., *Proc. Natl. Acad. Sci.* (*USA*) (1990) 87:3655; Wu et al., *J. Biol. Chem.* (1991) 266:338. Therapeutic compositions containing a polynucleotide are administered in a range of about 100 ng to about 200 mg of DNA for local administration in a gene therapy protocol. Concentration ranges of about 500 ng to about 50 mg, about 1 g to about 2 mg, about 5 g to about 500 g, and about 20 g to about 100 g of DNA can also be used during a gene therapy protocol. Factors such as method of action (e.g., for enhancing or inhibiting levels of the encoded gene product) and efficacy of transformation and expression are considerations which will affect the dosage required for ultimate efficacy of the antisense subgenomic polynucleotides. Where greater expression is desired over a larger area of tissue, larger amounts of antisense subgenomic polynucleotides or the same amounts readministered in a successive protocol of administrations, or several administrations to different adjacent or close tissue portions of, for example, a tumor site, may be required to effect a positive therapeutic outcome. In all cases, routine experimentation in clinical trials will determine specific ranges for optimal therapeutic effect. For polynucleotide-related genes encoding polypeptides or proteins with anti-inflammatory activity, suitable use, doses, and administration are described in U.S. Pat. No. 5,654,173.

The therapeutic polynucleotides and polypeptides of the present invention can be delivered using gene delivery vehicles. The gene delivery vehicle can be of viral or non-viral origin (see generally, Jolly, *Cancer Gene Therapy* (1994) 1:51; Kimura, *Human Gene Therapy* (1994) 5:845; Connelly, *Human Gene Therapy* (1995) 1:185; and Kaplitt, *Nature Genetics* (1994) 6:148). Expression of such coding sequences can be induced using endogenous mammalian or heterologous promoters. Expression of the coding sequence can be either constitutive or regulated.

Viral-based vectors for delivery of a desired polynucleotide and expression in a desired cell are well known in the art. Exemplary viral-based vehicles include, but are not limited to, recombinant retroviruses (see, e.g., WO 90/07936; WO 94/03622; WO 93/25698; WO 93/25234; U.S. Pat. No. 5,219,740; WO 93/11230; WO 93/10218; U.S. Pat. No. 4,777,127; GB Patent No. 2,200,651; EP 0 345 242; and WO 91/02805), alphavirus-based vectors (e.g., Sindbis virus vectors, Semliki forest virus (ATCC VR-67; ATCC VR-1247), Ross River virus (ATCC VR-373; ATCC VR-1246) and Venezuelan equine encephalitis virus (ATCC VR-923; ATCC VR-1250; ATCC VR 1249; ATCC VR-532), and adeno-associated virus (AAV) vectors (see, e.g., WO 94/12649, WO 93/03769; WO 93/19191; WO 94/28938; WO 95/11984 and WO 95/00655). Administration of DNA linked to killed adenovirus as described in Curiel, *Hum. Gene Ther.* (1992) 3:147 can also be employed.

Non-viral delivery vehicles and methods can also be employed, including, but not limited to, polycationic condensed DNA linked or unlinked to killed adenovirus alone (see, e.g., Curiel, *Hum. Gene Ther.* (1992) 3:147); ligand-linked DNA (see, e.g., Wu, *J. Biol. Chem.* (1989) 264: 16985); eukaryotic cell delivery vehicles cells (see, e.g., U.S. Pat. No. 5,814,482; WO 95/07994; WO 96/17072; WO 95/30763; and WO 97/42338) and nucleic charge neutralization or fusion with cell membranes. Naked DNA can also be employed. Exemplary naked DNA introduction methods are described in WO 90/11092 and U.S. Pat. No. 5,580,859. Liposomes that can act as gene delivery vehicles are described in U.S. Pat. No. 5,422,120; WO 95/13796; WO 94/23697; WO 91/14445; and EP 0524968. Additional approaches are described in Philip, *Mol. Cell Biol.* (1994) 14:2411, and in Woffendin, *Proc. Natl. Acad. Sci.* (1994) 91:1581

Further non-viral delivery suitable for use includes mechanical delivery systems such as the approach described in Woffendin et al., *Proc. Natl. Acad. Sci. USA* (1994) 91(24):11581. Moreover, the coding sequence and the product of expression of such can be delivered through deposition of photopolymerized hydrogel materials or use of ionizing radiation (see, e.g., U.S. Pat. No. 5,206,152 and WO 92/11033). Other conventional methods for gene delivery that can be used for delivery of the coding sequence include, for example, use of hand-held gene transfer particle gun (see, e.g., U.S. Pat. No. 5,149,655); use of ionizing radiation for activating transferred gene (see, e.g., U.S. Pat. No. 5,206,152 and WO 92/11033).

The present invention will now be illustrated by reference to the following examples which set forth particularly advantageous embodiments. However, it should be noted that these embodiments are illustrative and are not to be construed as restricting the invention in any way.

EXAMPLES

Example 1

Source of Biological Materials and Overview of Novel Polynucleotides Expressed by the Biological Materials cDNA libraries were constructed from either human colon cancer cell line Km12L4-A (Morikawa, et al., *Cancer Research* (1988) 48:6863), KM12C (Morikawa et al. *Cancer Res*. (1988) 48:1943–1948), or MDA-MB-231 (Brinkley et al. *Cancer Res*. (1980) 40:3118–3129) was used to construct a cDNA library from mRNA isolated from the cells. Sequences expressed by these cell lines were isolated and analyzed; most sequences were about 275–300 nucleotides in length. The KM12L4-A cell line is derived from the KM12C cell line. The KM12C cell line, which is poorly metastatic (low metastatic) was established in culture from a Dukes' stage $B_2$ surgical specimen (Morikawa et al. *Cancer Res*. (1988) 48:6863). The KML4-A is a highly metastatic subline derived from KM12C (Yeatman et al. *Nucl. Acids. Res*. (1995) 23:4007; Bao-Ling et al. *Proc. Annu. Meet. Am. Assoc. Cancer. Res*. (1995) 21:3269). The KM12C and KM12C-derived cell lines (e.g., KM12L4, KM12L4-A, etc.) are well-recognized in the art as a model cell line for the study of colon cancer (see, e.g., Moriakawa et al., supra; Radinsky et al. *Clin. Cancer Res*. (1995) 1:19; Yeatman et al., (1995) supra; Yeatman et al. *Clin. Exp. Metastasis* (1996) 14:246). The MDA-MB-231 cell line was originally isolated from pleural effusions (Cailleau, *J. Natl. Cancer. Inst*. (1974) 53:661), is of high metastatic potential, and forms poorly differentiated adenocarcinoma grade II in nude mice consistent with breast carcinoma.

The sequences of the isolated polynucleotides were first masked to eliminate low complexity sequences using the XBLAST masking program (Claverie "Effective Large-Scale Sequence Similarity Searches," In: *Computer Methods for Macromolecular Sequence Analysis*, Doolittle, ed., *Meth. Enzymol.* 266:212–227 Academic Press, NY, N.Y. (1996); see particularly Claverie, in "Automated DNA Sequencing and Analysis Techniques" Adams et al., eds., Chap. 36, p. 267 Academic Press, San Diego, 1994 and Claverie et al. *Comput. Chem*. (1993) 17:191). Generally, masking does not influence the final search results, except to eliminate sequences of relative little interest due to their low complexity, and to eliminate multiple "hits" based on similarity to repetitive regions common to multiple sequences, e.g., Alu repeats. Masking resulted in the elimination of 43 sequences. The remaining sequences were then used in a BLASTN vs. GenBank search; sequences that exhibited greater than 70% overlap, 99% identity, and a p value of less than $1 \times 10^{-40}$ were discarded. Sequences from this search also were discarded if the inclusive parameters were met, but the sequence was ribosomal or vector-derived.

The resulting sequences from the previous search were classified into three groups (1, 2 and 3 below) and searched in a BLASTX vs. NRP (non-redundant proteins) database search: (1) unknown (no hits in the GenBank search), (2) weak similarity (greater than 45% identity and p value of less than $1 \times 10^{-5}$), and (3) high similarity (greater than 60% overlap, greater than 80% identity, and p value less than $1 \times 10^{-5}$). Sequences having greater than 70% overlap, greater than 99% identity, and p value of less than $1 \times 10^{-40}$ were discarded.

The remaining sequences were classified as unknown (no hits), weak similarity, and high similarity (parameters as above). Two searches were performed on these sequences. First, a BLAST vs. EST database search was performed and sequences with greater than 99% overlap, greater than 99% similarity and a p value of less than $1 \times 10^{-40}$ were discarded. Sequences with a p value of less than $1 \times 10^{-65}$ when compared to a database sequence of human origin were also excluded. Second, a BLASTN vs. Patent GeneSeq database was performed and sequences having greater than 99% identity, p value less than $1 \times 10^{-40}$, and greater than 99% overlap were discarded.

The remaining sequences were subjected to screening using other rules and redundancies in the dataset. Sequences with a p value of less than $1 \times 10^{-111}$ in relation to a database sequence of human origin were specifically excluded. The final result provided the 1,565 sequences listed as SEQ ID NOS:1–1565 in the accompanying Sequence Listing and summarized in Table 1A (inserted prior to claims). Each identified polynucleotide represents sequence from at least a partial mRNA transcript.

Table 1A provides: 1) the SEQ ID NO assigned to each sequence for use in the present specification; 2) the filing date of the U.S. priority application in which the sequence was first filed; 3) the attorney docket number assigned to the priority application (for internal use); 4) the SEQ ID NO assigned to the sequence in the priority application; 5) the sequence name used as an internal identifier of the sequence; and 6) the name assigned to the clone from which the sequence was isolated. Because the provided polynucleotides represent partial mRNA transcripts, two or more polynucleotides of the invention may represent different regions of the same mRNA transcript and the same gene. Thus, if two or more SEQ ID NOS: are identified as belonging to the same clone, then either sequence can be used to obtain the full-length mRNA or gene.

In order to confirm the sequences of SEQ ID NOS: 1–1565, the clones were retrieved from a library using a robotic retrieval system, and the inserts of the retrieved clones re-sequenced. These "validation" sequences are provided as SEQ ID NOS:1566–2610 in the Sequence Listing, and a summary of the "validation" sequences provided in Table 1B (inserted prior to claims). Table 1B provides: 1) the SEQ ID NO assigned to each sequence for use in the present specification; 2) the sequence name assigned to the "validation" sequence obtained; 3) whether the "validation" sequence contains sequence that overlaps with an original sequence of SEQ ID NOS:1–1565 (Validation Overlap (VO)), or whether the "validation" sequence does not substantially overlap with an original sequence of SEQ ID NOS:1–1565 (indicated by Validation Non-Overlap (VNO)); and 4) where the sequence is indicated as VO, the name of the clone that contains the indicated "validation" sequence. "Validation" sequences are indicated as "VO" where the "validation" sequence overlaps with an original sequence (e.g., one of SEQ ID NOS:1–1565), and/or the "validation" sequence belongs to the same cluster as the original sequence using the clustering technique described above. Because the inserts of the clones are generally longer than the original sequence and the validation sequence, it is possible that a "validation" sequence can be obtained from the same clone as an original sequence but yet not share any of the sequence of the original. Such validation sequences will, however, belong to the same cluster as the original sequence using the clustering technique described above. VO "validation" sequences are contained within the same clone as the original sequence (one of SEQ ID NOS: 1–1565). "Validation" sequences that provided overlapping sequence are indicating by "VO" can be correlated with the original sequences they validate by referring to Table 1A. Sequences indicated as VNO are treated as newly isolated sequences and may or may not be related to the sequences of SEQ ID NOS:1–1565. Because the "validation" sequences are often longer than the original polynucleotide sequences and thus provide additional sequence information. All validation sequences can be obtained either from an indicated clone (e.g., for VO sequences) or from a cDNA library described herein (e.g., using primers designed from the sequence provided in the sequence listing).

Example 2

Results of Public Database Search to Identify Function of Gene Products

SEQ ID NOS:1566–2610 were translated in all three reading frames, and the nucleotide sequences and translated amino acid sequences used as query sequences to search for homologous sequences in either the GenBank (nucleotide sequences) or Non-Redundant Protein (amino acid sequences) databases. Query and individual sequences were aligned using the BLAST 2.0 programs, available over the world wide web at ncbi.nlm.nih.gov/BLAST (see also Altschul, et al. *Nucleic Acids Res*. (1997) 25:3389–3402). The sequences were masked to various extents to prevent searching of repetitive sequences or poly-A sequences, using the XBLAST program for masking low complexity as described above in Example 1.

Tables 2A and 2B (inserted before the claims) provide the alignment summaries having a p value of $1 \times 10^{-2}$ or less indicating substantial homology between the sequences of the present invention and those of the indicated public databases. Table 2A provides the SEQ ID NO of the query sequence, the accession number of the GenBank database entry of the homologous sequence, and the p value of the alignment. Table 2A provides the SEQ ID NO of the query sequence, the accession number of the Non-Redundant Protein database entry of the homologous sequence, and the p value of the alignment. The alignments provided in Tables 2A and 2B are the best available alignment to a DNA or amino acid sequence at a time just prior to filing of the present specification. The activity of the polypeptide encoded by the SEQ ID NOS listed in Tables 2A and 2B can be extrapolated to be substantially the same or substantially similar to the activity of the reported nearest neighbor or closely related sequence. The accession number of the nearest neighbor is reported, providing a publicly available reference to the activities and functions exhibited by the nearest neighbor. The public information regarding the activities and functions of each of the nearest neighbor sequences is incorporated by reference in this application. Also incorporated by reference is all publicly available information regarding the sequence, as well as the putative and actual activities and functions of the nearest neighbor sequences listed in Table 2 and their related sequences. The search program and database used for the alignment, as well as the calculation of the p value are also indicated.

Full length sequences or fragments of the polynucleotide sequences of the nearest neighbors can be used as probes and primers to identify and isolate the full length sequence of the corresponding polynucleotide. The nearest neighbors can indicate a tissue or cell type to be used to construct a library for the full-length sequences of the corresponding polynucleotides.

Example 3

Members of Protein Families

SEQ ID NOS:1566–2601 were used to conduct a profile search as described in the specification above. Several of the polynucleotides of the invention were found to encode polypeptides having characteristics of a polypeptide belonging to a known protein family (and thus represent new members of these protein families) and/or comprising a known functional domain (Table 3A, inserted prior to claims). Table 3A provides the SEQ ID NO: of the query sequence, a brief description of the profile hit, the position of the query sequence within the individual sequence (indicated as "start" and "stop"), and the orientation (Direction) of the query sequence with respect to the individual sequence, where forward (for) indicates that the alignment is in the same direction (left to right) as the sequence provided in the Sequence Listing and reverse (rev) indicates that the alignment is with a sequence complementary to the sequence provided in the Sequence Listing.

Some polynucleotides exhibited multiple profile hits where the query sequence contains overlapping profile regions, and/or where the sequence contains two different functional domains. Each of the profile hits of Table 3A are described in more detail below. The acronyms for the profiles (provided in parentheses) are those used to identify the profile in the Pfam and Prosite databases. The Pfam database can be accessed through any of the following URLS: pfam.wustl.edu/index; sanger.ac.uk/Software/Pfam; and cgr.ki.se/Pfam. The Prosite database can be accessed at expasy.ch/prosite. The public information available on the Pfam and Prosite databases regarding the various profiles, including but not limited to the activities, function, and consensus sequences of various proteins families and protein domains, is incorporated herein by reference.

14-3-3 Family (14 3 3). SEQ ID NO:1967 corresponds to a sequence encoding a 14-3-3 protein family member. The 14-3-3 protein family includes a group of closely related acidic homodimeric proteins of about 30 kD first identified as very abundant in mammalian brain tissues and located preferentially in neurons (Aitken et al. *Trends Biochem. Sci*. (1995) 20:95–97; Morrison *Science* (1994) 266:56–57; and Xiao et al. *Nature* (1995) 376:188–191). The 14-3-3 proteins have multiple biological activities, including a key role in signal transduction pathways and the cell cycle. 14-3-3 proteins interact with kinases (e.g., PKC or Raf-1), and can also function as protein-kinase dependent activators of tyrosine and tryptophan hydroxylases. The 14-3-3 protein sequences are extremely well conserved, and include two highly conserved regions: the first is a peptide of 11 residues located in the N-terminal section; the second, a 20 amino acid region located in the C-terminal section. The consensus patterns are as follows: 1) R-N-L-[LIV]-S-[VG]-[GA]-Y-[KN]-N-[IVA]; 2) Y-K-[DE]-S-T-L-I-[IM]-Q-L-[LF]-[RHC]-D-N-[LF]-T-[LS]-W-[TAN]-[SAD].

3'5'-Cyclin Nucleotide Phosphodiesterases (PDEase). SEQ ID NO: 2366 represents a polynucleotide encoding a novel 3'5'-cyclic nucleotide phosphodiesterase. PDEases catalyze the hydrolysis of cAMP or cGMP to the corresponding nucleoside 5' monophosphates (Charbonneau et al, *Proc. Natl. Acad. Sci. U.S.A.* (1986) 83:9308). There are at least seven different subfamilies of PDEases (Beavo et al., *Trends Pharmacol. Sci.* (1990) 11:150; http://weber.u.washington.edu/~pde/: 1) Type 1, calmodulin/calcium-dependent PDEases; 2) Type 2, cGMP-stimulated PDEases; 3) Type 3, cGMP-inhibited PDEases; 4) Type 4, cAMP-specific PDEases.; 5) Type 5, cGMP-specific PDEases; 6) Type 6, rhodopsin-sensitive cGMP-specific PDEases; and 7) Type 7, High affinity cAMP-specific PDEases. All PDEase forms share a conserved domain of about 270 residues. The signature pattern is determined from a stretch of 12 residues that contains two conserved histidines: H-D-[LIVMFY]-x-H-x-[AG]-x(2)-[NQ]-x-[LIVMFY].

Four Transmembrane Integral Membrane Proteins (transmembrane4). SEQ ID NOS:1579 and 1978 sequences correspond to a sequence encoding a member of the four transmembrane segments integral membrane protein family (tm4 family). The tm4 family of proteins includes a number of evolutionarily-related eukaryotic cell surface antigens (Levy et al., *J. Biol. Chem.*, (1991) 266:14597; Tomlinson et al., *Eur. J. Immunol.* (1993) 23:136; Barclay et al. The leucocyte antigen factbooks. (1993) Academic Press, London/San Diego). The tm4 family members are type III membrane proteins, which are integral membrane proteins containing an N-terminal membrane-anchoring domain that functions both as a translocation signal and as a membrane anchor. The family members also contain three additional transmembrane regions, at least seven conserved cysteines residues, and are of approximately the same size (218 to 284 residues). The consensus pattern spans a conserved region including two cysteines located in a short cytoplasmic loop between two transmembrane domains: Consensus pattern: G-x(3)-[LIVMF]-x(2)-[GSA]-[LIVMF](2)-G-C-x-[GA]-[STA]-x(2)-[EG]-x(2)-[CWN]-[LIVM](2).

Seven Transmembrane Integral Membrane Proteins—Rhodopsin Family (7tm 1). SEQ ID NOS:1652, 1927, and 2068 correspond to a sequence encoding a member of the seven transmembrane (7tm) receptor rhodopsin family. G-protein coupled receptors of the (7tm) rhodopsin family include hormones, neurotransmitters, and light receptors that transduce extracellular signals by interaction with guanine nucleotide-binding (G) proteins (Strosberg *Eur. J. Biochem.* (1991) 196:1, Kerlavage *Curr. Opin. Struct. Biol.* (1991) 1:394, Probst, et al., *DNA Cell Biol.* (1992) 11:1, Savarese, et al., Biochem. J. (1992) 283:1, gcrdb.uthsc-sa.edu, swift.embl-heidelberg.de/7tm) The consensus pattern that contains the conserved triplet and that also spans the major part of the third transmembrane helix is used to detect this widespread family of proteins: [GSTALIVM-FYWC]-[GSTANCPDE]-{EDPKRH}-x(2)-[LIVMN-QGA]-x(2)-[LIVMFT]-[GSTANC]-[LIVMFYWSTAC]-[DENH]-R-[FYWCSH]-x(2)-[LIVM].

Seven Transmembrane Integral Membrane Proteins—Secretin Family (7tm 2). SEQ ID NOS:1598, 1719, 1911, 1927, 2068, and 2341 correspond to a sequence encoding a member of the seven transmembrane receptor (7tm) secretin family (Jueppner et al. *Science* (1991) 254:1024; Hamann et al. *Genomics* (1996) 32:144). The N-terminal extracellular domain of these receptors contains five conserved cysteines residues involved in disulfide bonds, with a consensus pattern in the region that spans the first three cysteines. One of the most highly conserved regions spans the C-terminal part of the last transmembrane region and the beginning of the adjacent intracellular region and is used as a second signature pattern. The two consensus patterns are: 1) C-x(3)-[FYWLIV]-D-x(3,4)-C-[FW]-x(2)-[STAGV]-x(8,9)-C-[PF]; and 2) Q-G-[LMFCA]-[LIVMFT]-[LIV]-x-[LIVFST]-[LIF]-[VFYH]-C-[LFY]-x-N-x(2)-V ATPases Associated with Various Cellular Activities (ATPases). Several of the polynucleotides of the invention correspond to a sequence that encodes a member of a family of ATPases Associated with diverse cellular Activities (AAA). The AAA protein family is composed of a large number of ATPases that share a conserved region of about 220 amino acids containing an ATP-binding site (Froehlich et al., *J. Cell Biol.* (1991) 114:443; Erdmann et al. *Cell* (1991) 64:499; Peters et al., *EMBO J.* (1990) 9:1757; Kunau et al., *Biochimie* (1993) 75:209–224; Confalonieri et al., *BioEssays* (1995) 17:639; http://yeamob.pci.chemie.uni-tuebingen.de/AAA/Description.html). The AAA domain, which can be present in one or two copies, acts as an ATP-dependent protein clamp (Confalonieri et al. (1995) *BioEssays* 17:639) and contains a highly conserved region located in the central part of the domain. The consensus pattern is: [LIVMT]-x-[LIVMT]-[LIVMF]-x-[GATMC]-[ST]-[NS]-x(4)-[LIVM]-D-x-A-[LIFA]-x-R.

Basic Region Plus Leucine Zipper Transcription Factors (BZIP). SEQ ID NO:1623 represents a polynucleotide encoding a novel member of the family of basic region plus leucine zipper transcription factors. The bZIP superfamily (Hurst, *Protein Prof.* (1995) 2:105; and Ellenberger, *Curr. Opin. Struct. Biol.* (1994) 4:12) of eukaryotic DNA-binding transcription factors encompasses proteins that contain a basic region mediating sequence-specific DNA-binding followed by a leucine zipper required for dimerization. The consensus pattern for this protein family is: [KR]-x(1,3)-[RKSAQ]-N-x(2)-[SAQ](2)-x-[RKTAENQ]-x-R-x-[RK].

C2 domain (C2). SEQ ID NOS: 1715 and 2426 correspond to a sequence encoding a C2 domain, which is involved in calcium-dependent phospholipid binding (Davletov *J. Biol. Chem.* (1993) 268:26386–26390) or, in proteins that do not bind calcium, the domain may facilitate binding to inositol-1,3,4,5-tetraphosphate (Fukuda et al. *J. Biol. Chem.* (1994) 269:29206–29211; Sutton et al. *Cell* (1995) 80:929–938). The consensus sequence is: [ACG]-x(2)-L-x(2,3)-D-x(1,2)-[NGSTLIF]-[GTMR]-x-[STAP]-D-[PA]-[FY].

Cysteine proteases (Cys-protease). SEQ ID NO:2238 represents a polynucleotide encoding a protein having a eukaryotic thiol (cysteine) protease active site. Cysteine proteases (Dufour *Biochimie* (1988) 70:1335) are a family of proteolytic enzymes that contain an active site cysteine. Catalysis proceeds through a thioester intermediate and is facilitated by a nearby histidine side chain; an asparagine completes the essential catalytic triad. The sequences around the three active site residues are well conserved and can be used as signature patterns: Q-x(3)-[GE]-x-C-[YW]-x(2)-[STAGC]-[STAGCV] (where C is the active site residue); 2) [LIVMGSTAN]-x-H-[GSACE]-[LIVM]-x-[LIVMAT](2)-G-x-[GSADNH] (where H is the active site residue); and 3) [FYCH]-[WI]-[LIVT]-x-[KRQAG]-N-[ST]-W-x(3)-[FYW]-G-x(2)-G-[LFYW]-[LIVMFYG]-x-[LIVMF] (where N is the active site residue).

DEAD and DEAH box families ATP-dependent helicases (Dead box helic). SEQ ID NOS:1630, 1865, and 2517 represent polynucleotides encoding a novel member of the DEAD and DEAH box families (Schmid et al., *Mol. Microbiol.* (1992) 6:283; Linder et al., *Nature* (1989) 337:121; Wassarman, et al., *Nature* (1991) 349:463). All members of these families are involved in ATP-dependent, nucleic-acid unwinding. All DEAD box family members share a number of conserved sequence motifs, some of which are specific to the DEAD family, with others shared by other ATP-binding proteins or by proteins belonging to the helicases 'superfamily' (Hodgman *Nature* (1988) 333:22 and *Nature* (1988) 333:578 (Errata); http://www.expasy.ch/www/linder/HELICASES_TEXT.html). One of these motifs, called the 'D-E-A-D-box', represents a special version of the B motif of ATP-binding proteins. Proteins that have His instead of the second Asp and are 'D-E-A-H-box' proteins (Wassarman et al., *Nature* (1991) 349:463; Harosh, et al., *Nucleic Acids Res.* (1991) 19:6331; Koonin, et al., *J. Gen. Virol.* (1992) 73:989; http://www.expasy.ch/www/linder/HELICASES_TEXT.html). The following signature patterns are used to identify member for both subfamilies: 1) [LIVMF](2)-D-E-A-D-[RKEN]-x-[LIVMFYGSTN]; and 2) [GSAH]-x-[LIVMF](3)-D-E-[ALIV]-H-[NECR].

Dual specificity phosphatase (DSPc). Dual specificity phosphatases (DSPs) are Ser/Thr and Tyr protein phosphatases that comprise a tertiary fold highly similar to that of tyrosine-specific phosphatases, except for a "recognition" region connecting helix alpha1 to strand beta1. This tertiary fold may determine differences in substrate specific between VH-1 related dual specificity phosphatase (VHR), the protein tyrosine phosphatases (PTPs), and other DSPs. Phosphatases are important in the control of cell growth, proliferation, differentiation and transformation.

EF Hand (EFhand). SEQ ID NO:1595 corresponds to a polynucleotide encoding a member of the EF-hand protein family, a calcium binding domain shared by many calcium-binding proteins belonging to the same evolutionary family (Kawasaki et al., *Protein. Prof.* (1995) 2:305–490). The domain is a twelve residue loop flanked on both sides by a twelve residue alpha-helical domain, with a calcium ion coordinated in a pentagonal bipyramidal configuration. The six residues involved in the binding are in positions 1, 3, 5, 7, 9 and 12; these residues are denoted by X, Y, Z, -Y, -X and -Z. The invariant Glu or Asp at position 12 provides two oxygens for liganding Ca (bidentate ligand). The consensus pattern includes the complete EF-hand loop as well as the first residue which follows the loop and which seem to always be hydrophobic: D-x-[DNS]-{ILVFYW}-[DEN-STG]-[DNQGHRK]-{GP}-[LIVMC]-[DENQSTAGC]-x(2)-[DE]-[LIVMFYW].

Eukaryotic Aspartyl Proteases (asp). Several of the polynucleotides of the invention correspond to a sequence encoding a novel eukaryotic aspartyl protease. Aspartyl proteases, known as acid proteases, (EC 3.4.23.) are a widely distributed family of proteolytic enzymes (Foltmann., *Essays Biochem.* (1981) 17:52; Davies, *Annu. Rev. Biophys. Chem.* (1990) 19:189; Rao, et al., *Biochemistry* (1991) 30:4663) known to exist in vertebrates, fungi, plants, retroviruses and some plant viruses. Aspartate proteases of eukaryotes are monomeric enzymes which consist of two domains. Each domain contains an active site centered on a catalytic aspartyl residue. The consensus pattern to identify eukaryotic aspartyl protease is: [LIVMFGAC]-[LIVMTADN]-[LIVFSA]-D-[ST]-G-[STAV]-[STAP-DENQ]-x-[LIVMFSTNC]-x-[LIVMFGTA], where D is the active site residue.

Fibronectin Type II collagen-binding domain (FntypeII). SEQ ID NO: 1968 corresponds to a polynucleotide encoding a polypeptide having a type II fibronectin collagen binding domain. Fibronectin is a plasma protein that binds cell surfaces and various compounds including collagen, fibrin, heparin, DNA, and actin. The major part of the sequence of fibronectin consists of the repetition of three types of domains, called type I, II, and III (Skorstengaardet al., *Eur. J. Biochem.* (1986) 161:441). The type II domain, which is duplicated in fibronectin, is approximately forty residues long, contains four conserved cysteines involved in disulfide bonds and is part of the collagen-binding region of fibronectin. The consensus pattern for identifying members of this family, which pattern spans this entire domain, is: C-x(2)-P-F-x-[FYWI]-x(7)-C-x(8,10)-W-C-x(4)-[DNSR]-[FYW]-x(3,5)-[FYW]-x-[FYWI]-C (where the four C's are involved in disulfide bonds).

G-Protein Alpha Subunit (G-alpha). SEQ ID NO: 1779 corresponds to a gene encoding a member of the G-protein alpha subunit family. G-proteins are a family of membrane-associated proteins that couple extracellularly-activated integral-membrane receptors to intracellular effectors, such as ion channels and enzymes that vary the concentration of second messenger molecules. G-proteins are composed of 3 subunits (alpha, beta and gamma) which, in the resting state, associate as a trimer at the inner face of the plasma membrane. The alpha subunit, which binds GTP and exhibits GTPase activity, is about 350–400 amino acids in length with a molecular weight in the range of 40–45 kDa. Seventeen distinct types of alpha subunit have been identified in mammals, and fall into 4 main groups on the basis of both sequence similarity and function: alpha-s, alpha-q, alpha-i and alpha-12 (Simon et al., *Science* (1993) 252:802). They are often N-terminally acylated, usually with myristate and/or palmitoylate, and these fatty acid modifications can be important for membrane association and high-affinity interactions with other proteins.

Helicases conserved C-terminal domain (helicase C). SEQ ID NOS: 1621 and 1652 represent polynucleotides encoding novel members of the DEAD/H helicase family. The DEAD and DEAH families are described above.

Helix-Loop-Helix (HLH) DNA Binding Domain (HLH). SEQ ID NO:2192 corresponds to a sequence encoding an HLH domain. The HLH domain, which normally spans about 40 to 50 amino acids, is present in a number of eukaryotic transcription factors. The HLH domain is formed of two amphipathic helices joined by a variable length linker region that forms a loop that mediates protein dimerization (Murre et al. *Cell* (1989) 56:777–783). Basic HLH proteins (bHLH), which have an extra basic region of about 15 amino acid residues adjacent the HLH domain and specifically bind to DNA, include two groups: class A (ubiquitous) and class B (tissue-specific). bHLH family members bind variations of the E-box motif (CANNTG). The homo- or heterodimerization mediated by the HLH domain is independent of, but necessary for DNA binding, as two basic regions are required for DNA binding activity. The HLH proteins lacking the basic domain function as negative regulators since they form heterodimers, but fail to bind DNA. Consensus pattern: [DENSTAP]-[KTR]-[LIVMAGSNT]-{FY-WCPHKR}-[LIVMT]-[LIVM]-x(2)-[STAV]-[LIVM-STACKR]-x-[VMFYH]-[LIVMTA]-{P}-{P}-[LIVM-RKHQ].

Kinase Domain of Tors. The TOR profile is directed towards a lipid kinase protein family. This family is composed of large proteins with a lipid and protein kinase domain and characterized through their sensitivity to rapamycin (an antifungal compound). TOR proteins are involved in signal transduction downstream of P13 kinase and many other signals. TOR (also called FRAP, RAFT) plays a role in regulating protein synthesis and cell growth., and in yeast controls translation initiation and early G1 progression. See, e.g., Barbet et al. *Mol Biol Cell*. (1996) 7(1):25–42; Helliwell et al. *Genetics* (1998) 148:99–112.

MAP kinase kinase (mkk). SEQ ID NOS: 1825,1876, 2039, and 2526 represent members of the MAP kinase kinase (mkk) family. MAP kinases (MAPK) are involved in signal transduction, and are important in cell cycle and cell growth controls. The MAP kinase kinases (MAPKK) are dual-specificity protein kinases which phosphorylate and activate MAP kinases. MAPKK homologues have been found in yeast, invertebrates, amphibians, and mammals. Moreover, the MAPKK/MAPK phosphorylation switch constitutes a basic module activated in distinct pathways in yeast and in vertebrates. MAPKKs are essential transducers through which signals must pass before reaching the nucleus. For review, see, e.g., Biologique *Biol Cell* (1993) 79:193–207; Nishida et al., *Trends Biochem Sci* (1993) 18:128–31; Ruderman *Curr Opin Cell Biol* (1993) 5:207–13; Dhanasekaran et al., *Oncogene* (1998) 17:1447–55; Kiefer et al., *Biochem Soc Trans* (1997) 25:491–8; and Hill, *Cell Signal* (1996) 8:533–44.

Neurotransmitter-Gated Ion-Channel (neur_chan). Several of the sequences correspond to a sequence encoding a neurotransmitter-gated ion channel. Neurotransmitter-gated ion-channels, which provide the molecular basis for rapid signal transmission at chemical synapses, are post-synaptic oligomeric transmembrane complexes that transiently form a ionic channel upon the binding of a specific neurotransmitter. Five types of neurotransmitter-gated receptors are known: 1) nicotinic acetylcholine receptor (AchR); 2) glycine receptor; 3) gamma-aminobutyric-acid (GABA) receptor; 4) serotonin 5HT3 receptor; and 5) glutamate receptor. All known sequences of subunits from neurotransmitter-gated ion-channels are structurally related, and are composed of a large extracellular glycosylated N-terminal ligand-binding domain, followed by three hydrophobic transmembrane regions that form the ionic channel, followed by an intracellular region of variable length. A fourth hydrophobic region is found at the C-terminal of the sequence. The consensus pattern is: C-x-[LIVMFQ]-x-[LIVMF]-x(2)-[FY]-P-x-D-x(3)-C, where the two C's are linked by a disulfide bond.

Protein Kinase (protkinase). Several sequences represent polynucleotides encoding protein kinases, which catalyze phosphorylation of proteins in a variety of pathways, and are implicated in cancer. Eukaryotic protein kinases (Hanks, et al., *FASEB J*. (1995) 9:576; Hunter, *Meth. Enzymol*. (1991) 200:3; Hanks, et al., *Meth. Enzymol*. (1991) 200:38; Hanks, *Curr. Opin. Struct. Biol*. (1991) 1:369; Hanks et al., *Science* (1988) 241:42) belong to a very extensive family of proteins that share a conserved catalytic core common to both serine/threonine and tyrosine protein kinases. There are a number of conserved regions in the catalytic domain of protein kinases. The first region, located in the N-terminal extremity of the catalytic domain, is a glycine-rich stretch of residues in the vicinity of a lysine residue, which has been shown to be involved in ATP binding. The second region, located in the central part of the catalytic domain, contains a conserved an aspartic acid residue that is important for the catalytic activity of the enzyme (Knighton, et al., *Science* (1991) 253:407).

The protein kinase profile includes two signature patterns for this second region: one specific for serine/threonine kinases and the other for tyrosine kinases. A third profile is based on the alignment in (Hanks, et al., *FASEB J*. (1995) 9:576) and covers the entire catalytic domain. The consensus patterns are as follows: 1) [LIV]-G-{P}-G-{P}-[FYWMG-STNH]-[SGA]-{PW}-[LIVCAT]-{PD}-x-[GSTA-CLIVMFY]-x(5,18)-[LIVMFYWCSTAR]-[AIVP]-[LIVM-FAGCKR]-K, where K binds ATP; 2) [LIVMFYC]-x-[HY]-x-D-[LIVMFY]-K-x(2)-N-[LIVMFYCT](3), where D is an active site residue; and 3) [LIVMFYC]-x-[HY]-x-D-[LIVMFY]-[RSTAC]-x(2)-N-[LIVMFYC], where D is an active site residue.

Protein Tyrosine Phosphatase (Y phosphatase) (PTPase). SEQ ID NOS:1719, 1769, 2062, 2197, and 2275 represent polynucleotides encoding a tyrosine-specific protein phosphatase, a kinase that catalyzes the removal of a phosphate groups attached to a tyrosine residue (EC 3.1.3.48) (PTPase) (Fischer et al., *Science* (1991) 253:401; Charbonneau et al., *Annu. Rev. Cell Biol*. (1992) 8:463; Trowbridge *Biol. Chem*. (1991) 266:23517; Tonks et al., *Trends Biochem. Sci*. (1989) 14:497; and Hunter, *Cell* (1989) 58:1013). PTPases are important in the control of cell growth, proliferation, differentiation and transformation. Multiple forms of PTPase have been characterized and can be classified into two categories: soluble PTPases and transmembrane receptor proteins that contain PTPase domain(s). Structurally, all known receptor PTPases are made up of a variable length extracellular domain, followed by a transmembrane region and a C-terminal catalytic cytoplasmic domain. PTPase domains consist of about 300 amino acids. Two conserved cysteines are absolutely required for activity, with a number of other conserved residues in the immediate vicinity also important for activity. The consensus pattern for PTPases is: [LIVMF]-H-C-x(2)-G-x(3)-[STC]-[STAGP]-x-[LIVMFY]; C is the active site residue.

RNA Recognition Motif (rrm). SEQ ID NOS: 1850 and 2194 correspond to sequence encoding an RNA recognition motif, also known as an RRM, RBD, or RNP domain. This domain, which is about 90 amino acids long, is contained in eukaryotic proteins that bind single-stranded RNA (Bandziulis et al. *Genes Dev*. (1989) 3:431–437; Dreyfuss et al. *Trends Biochem. Sci*. (1988) 13:86–91). Two regions within the RNA-binding domain are highly conserved: the first is a hydrophobic segment of six residues (which is called the RNP-2 motif), the second is an octapeptide motif (which is called RNP-1 or RNP-CS). The consensus pattern is: [RK]-G-{EDRKHPCG}-[AGSCI]-[FY]-[LIVA]-x-[FYLM].

SH2 Domain (SH2). SEQ ID NO: 2441 corresponds to a sequence encoding an SH2 domain. The Src homology 2 (SH2) domain includes an approximately 100 amino acid residue domain, which is conserved in the oncoproteins Src and Fps, as well as in many other intracellular signal-transducing proteins (Sadowski et al. *Mol Cell. Biol*. (1986) 6:4396–4408; Russel et al. *FEBS Lett*. (1992) 304:15–20). SH2 domains function as regulatory modules of intracellular signaling cascades by interacting with high affinity to phosphotyrosine-containing target peptides in a sequence-specific and strictly phosphorylation-dependent manner. The SH2 domain has a conserved 3D structure consisting of two alpha helices and six to seven beta-strands. The core of the domain is formed by a continuous beta-meander composed of two connected beta-sheets (Kuriyan et al. *Curr. Opin. Struct. Biol*. (1993) 3:828–837).

Thioredoxin family active site (Thioredox). SEQ ID NO: 1618 represents a polynucleotide encoding a protein of the thioredoxin family. Thioredoxins are small proteins of approximately one hundred amino acid residues that participate in various redox reactions via the reversible oxidation of an active center disulfide bond (Holmgren, *Annu. Rev. Biochem.* (1985) 54:237; Gleason, et al., *FEMS Microbiol. Rev.* (1988) 54:271; Holmgren A. *J. Biol. Chem.* (1989) 264:13963; Eklund, et al. *Proteins* (1991) 11:13). Thioredoxins exist in either reduced or oxidized forms where the two cysteine residues are linked in an intramolecular disulfide bond. The sequence around the redox-active disulfide bond is well conserved. The consensus pattern is: [LIVMF]-[LIVMSTA]-x-[LIVMFYC]-[FYWSTHE]-x(2)-[FY-WGTN]-C-[GATPLVE]-[PHYWSTA]-C-x(6)-[LIVM-FYWT] (where the two C's form the redox-active bond).

Trypsin (trypsin). SEQ ID NOS: 1579, 2290, 2341, 2421, 2430, and 2438 correspond to novel serine proteases of the trypsin family. The catalytic activity of the serine proteases from the trypsin family is provided by a charge relay system involving an aspartic acid residue hydrogen-bonded to a histidine, which itself is hydrogen-bonded to a serine. The sequences in the vicinity of the active site serine and histidine residues are well conserved (Brenner *Nature* (1988) 334:528). The consensus patterns for the trypsin protein family are: 1) [LIVM]-[ST]-A-[STAG]-H-C, where H is the active site residue; and 2) [DNSTAGC]-[GSTAPIMVQH]-x(2)-G-[DE]-S-G-[GS]-[SAP]-[LIVM-FYWH]-[LIVMFYSTANQH], where S is the active site residue. All sequences known to belong to this family are detected by the above consensus sequences, except for 18 different proteases which have lost the first conserved glycine. If a protein includes both the serine and the histidine active site signatures, the probability of it being a trypsin family serine protease is 100%.

WD Domain, G-Beta Repeats (WD domain). SEQ ID NO: 2281 represents a members of the WD domain/G-beta repeat family. Beta-transducin (G-beta) is one of the three subunits (alpha, beta, and gamma) of the guanine nucleotide-binding proteins (G proteins) which act as intermediaries in the transduction of signals generated by transmembrane receptors (Gilman, *Annu. Rev. Biochem.* (1987) 56:615). The alpha subunit binds to and hydrolyzes GTP; the beta and gamma subunits are required for the replacement of GDP by GTP as well as for membrane anchoring and receptor recognition. In higher eukaryotes, G-beta exists as a small multigene family of highly conserved proteins of about 340 amino acid residues. Structurally, G-beta has eight tandem repeats of about 40 residues, each containing a central Trp-Asp motif (this type of repeat is sometimes called a WD-40 repeat). The consensus pattern for the WD domain/G-Beta repeat family is: [LIVMSTAC]-[LIVMFY-WSTAGC]-[LIMSTAG]-[LIVMSTAGC]-x(2)-[DN]-x(2)-[LIVMWSTAC]-x-[LIVMFSTAG]-W-[DEN]-[LIVMF-STAGCN].

wnt Family of Developmental Signaling Proteins (Wnt dev sign). Several of the sequences correspond to novel members of the wnt family of developmental signaling proteins. Wnt-1 (previously known as int-1), the seminal member of this family, (Nusse, *Trends Genet.* (1988) 4:291) plays a role in intercellular communication and is important in central nervous system development. All wnt family proteins share the following features characteristic of secretory proteins: a signal peptide, several potential N-glycosylation sites and 22 conserved cysteines that may be involved in disulfide bonds. Wnt proteins generally adhere to the plasma membrane of secreting cells and are therefore likely to signal over only few cell diameters. The consensus pattern, which is based upon a highly conserved region including three cysteines, is as follows: C-K-C-H-G-[LIVMT]-S-G-x-C.

Zinc Finger, $C_2H_2$ Type (Zincfing $C_2H_2$). SEQ ID NOS: 1735, 1942, 2018, 2254, and 2515 correspond to polynucleotides encoding members of the $C_2H_2$ type zinc finger protein family, which contain zinc finger domains that facilitate nucleic acid binding (Klug et al., *Trends Biochem. Sci.* (1987) 12:464; Evans et al., *Cell* (1988) 52:1; Payre et al., *FEBS Lett.* (1988) 234:245; Miller et al., *EMBO J.* (1985) 4:1609; and Berg, *Proc. Natl. Acad. Sci. USA* (1988) 85:99). In addition to the conserved zinc ligand residues, a number of other positions are also important for the structural integrity of the $C_2H_2$ zinc fingers. (Rosenfeld et al., *J. Biomol. Struct. Dyn.* (1993) 11:557) The best conserved position, which is generally an aromatic or aliphatic residue, is located four residues after the second cysteine. The consensus pattern for $C_2H_2$ zinc fingers is: C-x(2,4)-C-x(3)-[LIVMFYWC]-x(8)-H-x(3,5)-H. The two C's and two H's are zinc ligands.

Example 4

Differential Expression of Polynucleotides of the Invention: Description of Libraries and Detection of Differential Expression The relative expression levels of the polynucleotides of the invention was assessed in several libraries prepared from various sources, including cell lines and patient tissue samples. Table 4 provides a summary of these libraries, including the shortened library name (used hereafter), the mRNA source used to prepared the cDNA library, the "nickname" of the library that is used in the tables below (in quotes), and the approximate number of clones in the library.

TABLE 4

Description of cDNA Libraries

| Library (lib #) | Description | Number of Clones in Cluster |
|---|---|---|
| 1 | Km12L4 Human Colon Cell Line, High Metastatic Potential (derived from Km12C); "High Met Colon" | 307133 |
| 2 | Km12C Human Colon Cell Line, Low Metastatic Potential; "Low Met Colon" | 284755 |
| 3 | MDA-MB-231 Human Breast Cancer Cell Line, High Metastatic Potential; micrometastases in lung; "High Met Breast" | 326937 |
| 4 | MCF7 Human Breast Cancer Cell, Non Metastatic; "Low Met Breast" | 318979 |
| 8 | MV-522 Human Lung Cancer Cell Line, High Metastatic Potential; "High Met Lung" | 223620 |
| 9 | UCP-3 Human Lung Cancer Cell Line, Low Metastatic Potential; "Low Met Lung" | 312503 |
| 12 | Human microvascular endothelial cells (HMEC) - Untreated PCR (OligodT) cDNA library; "HMEC" | 41938 |
| 13 | Human microvascular endothelial cells (HMEC) - Basic fibroblast growth factor (bFGF) treated PCR (OligodT) cDNA library; "HMEC-bFGF" | 42100 |
| 14 | Human microvascular endothelial cells (HMEC) - Vascular endothelial growth factor (VEGF) treated PCR (OligodT) cDNA library; "HMEC-VEGF" | 42825 |
| 15 | Normal Colon - UC#2 Patient PCR (OligodT) cDNA library; "Normal Colon Tissue" | 282722 |
| 16 | Colon Tumor - UC#2 Patient PCR (OligodT) cDNA library; "Normal Colon Tumor Tissue" | 298831 |

TABLE 4-continued

Description of cDNA Libraries

| Library (lib #) | Description | Number of Clones in Cluster |
|---|---|---|
| 17 | Liver Metastasis from Colon Tumor of UC#2 Patient PCR (OligodT) cDNA library; "High Met Colon Tissue" | 303467 |
| 18 | Normal Colon - UC#3 Patient PCR (OligodT) cDNA library; "Normal Colon Tissue" | 36216 |
| 19 | Colon Tumor - UC#3 Patient PCR (OligodT) cDNA library; "Colon Tumor Tissue" | 41388 |
| 20 | Liver Metastasis from Colon Tumor of UC#3 Patient PCR (OligodT) cDNA library; "High Met Colon Tissue" | 30956 |
| 21 | GRRpz Human Prostate Cell Line; "Normal Prostate" | 164801 |
| 22 | Woca Human Prostate Cancer Cell Line; "Prostate Cancer" | 162088 |

The KM12L4, KM12C, and MDA-MB-231 cell lines are described in Example 1 above. The MCF7 cell line was derived from a pleural effusion of a breast adenocarcinoma and is non-metastatic. The MV-522 cell line is derived from a human lung carcinoma and is of high metastatic potential. The UCP-3 cell line is a low metastatic human lung carcinoma cell line; the MV-522 is a high metastatic variant of UCP-3. These cell lines are well-recognized in the art as models for the study of human breast and lung cancer (see, e.g., Chandrasekaran et al., *Cancer Res.* (1979) 39:870 (MDA-MB-231 and MCF-7); Gastpar et al., *J Med Chem* (1998) 41:4965 (MDA-MB-231 and MCF-7); Ranson et al., *Br J Cancer* (1998) 77:1586 (MDA-MB-231 and MCF-7); Kuang et al., *Nucleic Acids Res* (1998)26:1116 (MDA-MB-231 and MCF-7); Varki et al., *Int J Cancer* (1987) 40:46 (UCP-3); Varki et al., *Tumour Biol.* (1990) 11:327; (MV-522 and UCP-3); Varki et al., *Anticancer Res.* (1990) 10:637; (MV-522); Kelner et al., *Anticancer Res* (1995) 15:867 (MV-522); and Zhang et al., *Anticancer Drugs* (1997) 8:696 (MV522)). The samples of libraries 15–20 are derived from two different patients (UC#2, and UC#3). The bFGF-treated HMEC were prepared by incubation with bFGF at 10 ng/ml for 2 hrs; the VEGF-treated HMEC were prepared by incubation with 20 ng/ml VEGF for 2 hrs. Following incubation with the respective growth factor, the cells were washed and lysis buffer added for RNA preparation. The GRRpz and WOca cell lines were provided by Dr. Donna M. Peehl, Department of Medicine, Stanford University School of Medicine. GRRpz was derived from normal prostate epithelium. The WOca cell line is a Gleason Grade 4 cell line.

Each of the libraries is composed of a collection of cDNA clones that in turn are representative of the mRNAs expressed in the indicated mRNA source. In order to facilitate the analysis of the millions of sequences in each library, the sequences were assigned to clusters. The concept of "cluster of clones" is derived from a sorting/grouping of cDNA clones based on their hybridization pattern to a panel of roughly 300 7 bp oligonucleotide probes (see Drmanac et al., *Genomics* (1996) 37(1):29). Random cDNA clones from a tissue library are hybridized at moderate stringency to 300 7 bp oligonucleotides. Each oligonucleotide has some measure of specific hybridization to that specific clone. The combination of 300 of these measures of hybridization for 300 probes equals the "hybridization signature" for a specific clone. Clones with similar sequence will have similar hybridization signatures. By developing a sorting/grouping algorithm to analyze these signatures, groups of clones in a library can be identified and brought together computationally. These groups of clones are termed "clusters". Depending on the stringency of the selection in the algorithm (similar to the stringency of hybridization in a classic library cDNA screening protocol), the "purity" of each cluster can be controlled. For example, artifacts of clustering may occur in computational clustering just as artifacts can occur in "wet-lab" screening of a cDNA library with 400 bp cDNA fragments, even at the highest stringency. The stringency used in the implementation of cluster herein provides groups of clones that are in general from the same cDNA or closely related cDNAs. Closely related clones can be a result of different length clones of the same cDNA, closely related clones from highly related gene families, or splice variants of the same cDNA.

Differential expression for a selected cluster was assessed by first determining the number of cDNA clones corresponding to the selected cluster in the first library (Clones in $1^{st}$), and the determining the number of cDNA clones corresponding to the selected cluster in the second library (Clones in $2^{nd}$). Differential expression of the selected cluster in the first library relative to the second library is expressed as a "ratio" of percent expression between the two libraries. In general, the "ratio" is calculated by: 1) calculating the percent expression of the selected cluster in the first library by dividing the number of clones corresponding to a selected cluster in the first library by the total number of clones analyzed from the first library; 2) calculating the percent expression of the selected cluster in the second library by dividing the number of clones corresponding to a selected cluster in a second library by the total number of clones analyzed from the second library; 3) dividing the calculated percent expression from the first library by the calculated percent expression from the second library. If the "number of clones" corresponding to a selected cluster in a library is zero, the value is set at 1 to aid in calculation. The formula used in calculating the ratio takes into account the "depth" of each of the libraries being compared, i.e., the total number of clones analyzed in each library.

In general, a polynucleotide is said to be significantly differentially expressed between two samples when the ratio value is greater than at least about 2, preferably greater than at least about 3, more preferably greater than at least about 5, where the ratio value is calculated using the method described above. The significance of differential expression is determined using a z score test (Zar, *Biostatistical Analysis*, Prentice Hall, Inc., USA, "Differences between Proportions," pp 296–298 (1974).

Examples 5–12

Differential Expression of Polynucleotides of the Invention

A number of polynucleotide sequences have been identified that are differentially expressed between, for example, cells derived from high metastatic potential cancer tissue and low metastatic cancer cells, and between cells derived from high metastatic potential cancer tissue and normal tissue. Evaluation of the levels of expression of the genes corresponding to these sequences can be valuable in diagnosis, prognosis, and/or treatment (e.g., to facilitate rationale design of therapy, monitoring during and after therapy, etc.). Moreover, the genes corresponding to differentially expressed sequences described herein can be therapeutic targets due to their involvement in regulation (e.g., inhibition or promotion) of development of, for example, the metastatic phenotype. For example, sequences that correspond to genes that are increased in expression in high metastatic potential cells relative to normal or non-metastatic tumor cells may encode genes or regulatory sequences involved in processes such as angiogenesis, differentiation, cell replication, and metastasis.

Detection of the relative expression levels of differentially expressed polynucleotides described herein can provide valuable information to guide the clinician in the choice of therapy. For example, a patient sample exhibiting an expression level of one or more of these polynucleotides that corresponds to a gene that is increased in expression in metastatic or high metastatic potential cells may warrant more aggressive treatment for the patient. In contrast, detection of expression levels of a polynucleotide sequence that corresponds to expression levels associated with that of low metastatic potential cells may warrant a more positive prognosis than the gross pathology would suggest.

A number of polynucleotide sequences of the present invention are differentially expressed between human microvascular endothelial cells (HMEC) that have been treated with growth factors relative to untreated HMEC. Sequences that are differentially expressed between growth factor-treated HMEC and untreated HMEC can represent sequences encoding gene products involved in angiogenesis, metastasis (cell migration), and other development and oncogenic processes. For example, sequences that are more highly expressed in HMEC treated with growth factors (such as bFGF or VEGF) relative to untreated HMEC can serve as markers of cancer cells of higher metastatic potential. Detection of expression of these sequences in colon cancer tissue can be valuable in determining diagnostic, prognostic and/or treatment information associated with the prevention of achieving the malignant state in these tissues, and can be important in risk assessment for a patient. A patient sample displaying an increased level of one or more of these polynucleotides may thus warrant closer attention or more frequent screening procedures to catch the malignant state as early as possible.

The differential expression of the polynucleotides described herein can thus be used as, for example, diagnostic markers, prognostic markers, for risk assessment, patient treatment and the like. These polynucleotide sequences can also be used in combination with other known molecular and/or biochemical markers. The following examples provide relative expression levels of polynucleotides from specified cell lines and patient tissue samples.

Example 5

High Metastatic Potential Breast Cancer Versus Low Metastatic Breast Cancer Cells The following tables summarize polynucleotides that represent genes that are differentially expressed between high metastatic potential and low metastatic potential breast cancer cells.

TABLE 5

High metastatic potential breast (lib3) > low metastatic potential (lib4) breast cancer cells

| SEQ ID NO: | Lib3 Clones | Lib4 Clones | Lib3/Lib4 |
|---|---|---|---|
| 1213 | 40 | 0 | 39 |
| 1538 | 60 | 3 | 20 |

TABLE 5-continued

High metastatic potential breast (lib3) > low metastatic potential (lib4) breast cancer cells

| SEQ ID NO: | Lib3 Clones | Lib4 Clones | Lib3/Lib4 |
|---|---|---|---|
| 1466 | 14 | 0 | 14 |
| 1356 | 10 | 0 | 10 |
| 1383 | 10 | 1 | 10 |
| 1158 | 10 | 1 | 10 |
| 441 | 10 | 1 | 10 |
| 1338 | 10 | 0 | 10 |
| 1426 | 19 | 2 | 9 |
| 1547 | 9 | 1 | 9 |
| 1313 | 8 | 1 | 8 |
| 841 | 8 | 1 | 8 |
| 1534 | 8 | 0 | 8 |
| 1503 | 8 | 0 | 8 |
| 829 | 8 | 1 | 8 |
| 1408 | 8 | 0 | 8 |
| 1447 | 7 | 0 | 7 |
| 1389 | 7 | 0 | 7 |
| 356 | 7 | 0 | 7 |
| 1492 | 7 | 0 | 7 |
| 1543 | 22 | 3 | 7 |
| 799 | 7 | 0 | 7 |
| 1437 | 6 | 0 | 6 |
| 1251 | 6 | 0 | 6 |
| 972 | 18 | 3 | 6 |
| 1482 | 6 | 0 | 6 |
| 1299 | 6 | 0 | 6 |
| 109 | 24 | 4 | 6 |
| 1558 | 6 | 0 | 6 |
| 1355 | 6 | 0 | 6 |
| 1548 | 11 | 2 | 5 |
| 250 | 10 | 2 | 5 |
| 919 | 26 | 6 | 4 |
| 358 | 36 | 12 | 3 |
| 1525 | 75 | 28 | 3 |
| 1157 | 49 | 17 | 3 |

TABLE 6

Low metastatic potential breast (lib4) > high metastatic potential breast cancer cells (lib3)

| SEQ ID NO: | Lib3 Clones | Lib4 Clones | Lib4/Lib3 |
|---|---|---|---|
| 248 | 0 | 58 | 59 |
| 726 | 1 | 23 | 24 |
| 14 | 1 | 19 | 19 |
| 699 | 0 | 14 | 14 |
| 763 | 1 | 14 | 14 |
| 20 | 1 | 13 | 13 |
| 79 | 1 | 13 | 13 |
| 715 | 0 | 10 | 10 |
| 991 | 0 | 8 | 8 |
| 1199 | 0 | 8 | 8 |
| 707 | 0 | 7 | 7 |
| 1128 | 4 | 26 | 7 |
| 891 | 0 | 6 | 6 |
| 1146 | 2 | 11 | 6 |
| 731 | 7 | 44 | 6 |
| 1518 | 3 | 15 | 5 |
| 340 | 3 | 13 | 4 |
| 949 | 4 | 13 | 3 |
| 1247 | 7 | 18 | 3 |
| 1185 | 497 | 1216 | 3 |

Example 6

High Metastatic Potential Lung Cancer Versus Low Metastatic Lung Cancer Cells

The following summarizes polynucleotides that represent genes differentially expressed between high metastatic potential lung cancer cells and low metastatic potential lung cancer cells:

TABLE 7

High metastatic potential lung (lib8) > low metastatic potential lung (lib9) lung cancer cells

| SEQ ID NO: | Lib8 Clones | Lib9 Clones | Lib8/Lib9 |
|---|---|---|---|
| 150 | 31 | 0 | 43 |
| 651 | 43 | 2 | 30 |
| 1298 | 14 | 1 | 20 |
| 57 | 11 | 0 | 15 |
| 625 | 7 | 0 | 10 |
| 1322 | 7 | 1 | 10 |
| 36 | 7 | 0 | 10 |
| 621 | 18 | 3 | 8 |
| 215 | 6 | 1 | 8 |
| 561 | 19 | 4 | 7 |
| 247 | 5 | 0 | 7 |
| 199 | 5 | 0 | 7 |
| 998 | 5 | 0 | 7 |
| 502 | 5 | 0 | 7 |
| 1382 | 8 | 2 | 6 |
| 1181 | 17 | 4 | 6 |
| 1309 | 8 | 2 | 6 |
| 1157 | 15 | 4 | 5 |
| 1260 | 14 | 5 | 4 |
| 1185 | 710 | 266 | 4 |
| 1525 | 21 | 10 | 3 |

TABLE 8

Low metastatic potential lung (lib9) > high metastatic potential lung (lib8) cancer cells

| SEQ ID NO: | Lib8 Clones | Lib9 Clones | Lib9/Lib8 |
|---|---|---|---|
| 924 | 1 | 13 | 9 |
| 822 | 1 | 13 | 9 |
| 728 | 1 | 12 | 9 |
| 341 | 1 | 12 | 9 |
| 1527 | 3 | 31 | 7 |
| 698 | 4 | 26 | 5 |
| 949 | 2 | 15 | 5 |
| 744 | 3 | 23 | 5 |
| 973 | 8 | 27 | 2 |

Example 7

High Metastatic Potential Colon Cancer Versus Low Metastatic Colon Cancer Cells

Tables 9 and 10 summarize polynucleotides that represent genes differentially expressed between high metastatic potential and low metastatic potential colon cancer cells:

TABLE 9

High metastatic potential (lib1) > low metastatic potential (lib2) colon cancer cells

| SEQ ID NO: | Lib1 Clones | Lib2 Clones | Lib1/Lib2 |
|---|---|---|---|
| 248 | 67 | 2 | 31 |
| 87 | 12 | 0 | 11 |
| 698 | 11 | 0 | 10 |
| 57 | 13 | 3 | 4 |
| 924 | 24 | 10 | 2 |
| 1249 | 24 | 9 | 2 |

TABLE 10

Low metastatic potential (lib2) > high metastatic potential colon cancer (lib1) cells

| SEQ ID NO: | Lib1 Clones | Lib2 Clones | Lib2/Lib1 |
|---|---|---|---|
| 1268 | 1 | 17 | 18 |
| 1114 | 0 | 15 | 16 |
| 1032 | 1 | 14 | 15 |
| 109 | 5 | 60 | 13 |
| 973 | 1 | 11 | 12 |
| 91 | 1 | 11 | 12 |
| 982 | 0 | 9 | 10 |
| 1267 | 3 | 28 | 10 |
| 93 | 1 | 8 | 9 |
| 1556 | 1 | 8 | 9 |
| 1251 | 0 | 8 | 9 |
| 1206 | 2 | 17 | 9 |
| 812 | 0 | 8 | 9 |
| 1254 | 0 | 7 | 8 |
| 1220 | 0 | 7 | 8 |
| 766 | 0 | 7 | 8 |
| 1156 | 0 | 7 | 8 |
| 1007 | 0 | 7 | 8 |
| 981 | 0 | 7 | 8 |
| 762 | 0 | 7 | 8 |
| 876 | 0 | 6 | 6 |
| 1234 | 2 | 11 | 6 |
| 1183 | 0 | 6 | 6 |
| 1044 | 2 | 12 | 6 |
| 785 | 0 | 6 | 6 |
| 1069 | 3 | 17 | 6 |
| 770 | 0 | 6 | 6 |
| 778 | 0 | 6 | 6 |
| 792 | 0 | 6 | 6 |
| 822 | 2 | 10 | 5 |
| 1258 | 7 | 23 | 4 |
| 1224 | 7 | 17 | 3 |
| 984 | 8 | 19 | 3 |
| 841 | 10 | 28 | 3 |
| 339 | 14 | 34 | 3 |
| 1213 | 11 | 29 | 3 |
| 1201 | 5 | 14 | 3 |
| 1192 | 22 | 48 | 2 |

Example 8

High Metastatic Potential Colon Cancer Patient Tissue Vs. Normal Patient Tissue

Tables 11 summarizes polynucleotides that represent genes differentially expressed between high metastatic potential colon cancer cells and normal colon cells of patient tissue.

TABLE 11

High metastatic potential colon tissue (lib17) vs. normal colon tissue (lib 15)

| SEQ ID NO: | Lib15 Clones | Lib17 Clones |
|---|---|---|
| | | Lib17/Lib15 |
| 1422 | 1 | 13 | 12 |
| 1132 | 1 | 10 | 9 |
| 730 | 1 | 9 | 8 |
| 1311 | 0 | 7 | 7 |
| 78 | 9 | 48 | 5 |
| 822 | 5 | 20 | 4 |
| | | | Lib15/Lib17 |
| 463 | 8 | 1 | 9 |

Example 9

High Tumor Potential Colon Tissue Vs. Metastasized Colon Cancer Tissue

The following table summarizes polynucleotides that represent genes differentially expressed between high tumor potential colon cancer cels and cells derived from high metastatic potential colon cancer cells of a patient.

TABLE 12

High tumor potential colon tissue (lib16) vs. high metastatic colon tissue (lib 17)

| SEQ ID NO: | Lib16 Clones | Lib17 Clones | Lib16/Lib17 |
|---|---|---|---|
| 1185 | 14 | 4 | 4 |

| | | | Lib17/Lib16 |
|---|---|---|---|
| 822 | 2 | 20 | 10 |

Example 10

High Tumor Potential Colon Cancer Patient Tissue Versus Normal Patient Tissue Tables 13 and 14 summarize polynucleotides that represent genes differentially expressed between high metastatic potential colon cancer cells and normal colon cells in patient tissue:

TABLE 13

Higher expression in tumor potential colon tissue (lib16) vs. normal colon tissue (lib15)

| SEQ ID NO: | Lib15 Clones | Lib16 Clones | Lib16/Lib15 |
|---|---|---|---|
| 1311 | 0 | 8 | 8 |
| 78 | 9 | 28 | 3 |

TABLE 14

Higher expression in normal colon tissue (lib15) vs. tumor potential colon tissue (lib16)

| SEQ ID NO: | Lib15 Clones | Lib16 Clones | Lib15/Lib16 |
|---|---|---|---|
| 463 | 8 | 0 | 8 |
| 1099 | 12 | 3 | 4 |

Example 11

Growth Factor-Stimulated Human Microvascular Endothelial Cells (HMEC) Relative to Untreated HMEC The following tables summarize polynucleotides that represent genes differentially expressed between growth factor-treated and untreated HMEC.

TABLE 15

Higher expression in bFGF treated HMEC (lib13) vs. untreated HMEC (lib12)

| SEQ ID NO: | Lib12 Clones | Lib13 Clones | Lib13/Lib12 |
|---|---|---|---|
| 1520 | 9 | 23 | 3 |
| 1538 | 17 | 35 | 2 |

TABLE 16

Higher expression in VEGF treated HMEC (lib14) vs. untreated HMEC (lib12)

| SEQ ID NO: | Lib12 Clones | Lib14 Clones | Lib14/Lib12 |
|---|---|---|---|
| 1154 | 2 | 12 | 6 |
| 1226 | 2 | 10 | 5 |
| 1538 | 17 | 38 | 2 |

Example 12

Polynucleotides Differentially Expressed in Human Prostate Cancer Cells Relative to Normal Human Prostate Cells The following tables summarize identified polynucleotides that represent genes differentially expressed between prostate cancer cells and normal prostate cells:

TABLE 17

Higher expression in normal prostate cells (lib21) relative to prostate cancer cells (lib22)

| SEQ ID NO: | Lib21 Clones | Lib22 Clones | Lib21/Lib22 |
|---|---|---|---|
| 1525 | 6 | 0 | 6 |
| 248 | 116 | 51 | 2 |
| 1203 | 22 | 9 | 2 |

TABLE 18

Higher expression in prostate cancer cells (lib22) relative to normal prostate cells (lib21)

| SEQ ID NO: | Lib21 Clones | Lib22 Clones | Lib22/Lib21 |
|---|---|---|---|
| 1213 | 0 | 34 | 35 |
| 340 | 1 | 12 | 12 |
| 699 | 0 | 11 | 11 |

Example 13

Differential Expression Across Multiple Libraries

A number of polynucleotide sequences have been identified that represent genes that are differentially expressed across multiple libraries. Expression of these sequences in a tissue or any origin can be valuable in determining diagnostic, prognostic and/or treatment information associated with the prevention of achieving the malignant state in these tissues, and can be important in risk assessment for a patient. These polynucleotides can also serve as non-tissue specific markers of, for example, risk of metastasis of a tumor. Table 19 summarizes this data.

TABLE 19

Genes Differentially Expressed Across Multiple Library Comparisons

| SEQ ID NO: | Cell or Tissue Sample and Cancer State Compared | Ratio |
|---|---|---|
| 57 | High Met Lung (lib8) > Low Met Lung (lib9) | 15 |
| 57 | High Met Colon (lib1) > Low Met Colon (lib2) | 4 |
| 78 | High Met Colon Tissue (lib17) > Normal Colon Tissue (lib15) | 5 |
| 78 | Normal Colon Tumor Tissue (lib16) > Normal Colon Tissue (lib15) | 3 |
| 109 | High Met Breast (lib3) > Low Met Breast (lib4) | 6 |
| 109 | Low Met Colon (lib2) > High Met Colon (lib1) | 13 |
| 248 | High Met Colon (lib1) > Low Met Colon (lib2) | 31 |
| 248 | Normal Prostate (lib21) > Prostate Cancer (lib22) | 2 |
| 248 | Low Met Breast (lib4) > High Met Breast (lib3) | 59 |
| 340 | Prostate Cancer (lib22) > Normal Prostate (lib21) | 12 |
| 340 | Low Met Breast (lib4) > High Met Breast (lib3) | 4 |
| 463 | Normal Colon Tissue (lib15) > High Met Colon Tissue (lib17) | 9 |
| 463 | Normal Colon Tissue (lib15) > Normal Colon Tumor Tissue (lib16) | 8 |
| 698 | High Met Colon (lib1) > Low Met Colon (lib2) | 10 |
| 698 | Low Met Lung (lib9) > High Met Lung (lib8) | 5 |
| 699 | Low Met Breast (lib4) > High Met Breast (lib3) | 14 |
| 699 | Prostate Cancer (lib22) > Normal Prostate (lib21) | 11 |
| 822 | High Met Colon Tissue (lib17) > Normal Colon Tumor Tissue (lib16) | 10 |
| 822 | Low Met Lung (lib9) > High Met Lung (lib8) | 9 |
| 822 | Low Met Colon (lib2) > High Met Colon (lib1) | 5 |
| 822 | High Met Colon Tissue (lib17) > Normal Colon Tissue (lib15) | 4 |
| 841 | High Met Breast (lib3) > Low Met Breast (lib4) | 8 |
| 841 | Low Met Colon (lib2) > High Met Colon (lib1) | 3 |
| 924 | High Met Colon (lib1) > Low Met Colon (lib2) | 2 |
| 924 | Low Met Lung (lib9) > High Met Lung (lib8) | 9 |
| 949 | Low Met Lung (lib9) > High Met Lung (lib8) | 5 |
| 949 | Low Met Breast (lib4) > High Met Breast (lib3) | 3 |
| 973 | Low Met Colon (lib2) > High Met Colon (lib1) | 12 |
| 973 | Low Met Lung (lib9) > High Met Lung (lib8) | 2 |
| 1157 | High Met Lung (lib8) > Low Met Lung (lib9) | 5 |
| 1157 | High Met Breast (lib3) > Low Met Breast (lib4) | 3 |
| 1185 | Normal Colon Tumor Tissue (lib16) > High Met Colon Tissue (lib17) | 4 |
| 1185 | High Met Lung (lib8) > Low Met Lung (lib9) | 4 |
| 1185 | Low Met Breast (lib4) > High Met Breast (lib3) | 3 |
| 1213 | High Met Breast (lib3) > Low Met Breast (lib4) | 39 |
| 1213 | Prostate Cancer (lib22) > Normal Prostate (lib21) | 35 |
| 1213 | Low Met Colon (lib2) > High Met Colon (lib1) | 3 |
| 1251 | High Met Breast (lib3) > Low Met Breast (lib4) | 6 |
| 1251 | Low Met Colon (lib2) > High Met Colon (lib1) | 9 |
| 1311 | Normal Colon Tumor Tissue (lib16) > Normal Colon Tissue (lib15) | 8 |
| 1311 | High Met Colon Tissue (lib17) > Normal Colon Tissue (lib15) | 7 |
| 1525 | Normal Prostate (lib21) > Prostate Cancer (lib22) | 6 |
| 1525 | High Met Lung (lib8) > Low Met Lung (lib9) | 3 |
| 1525 | High Met Breast (lib3) > Low Met Breast (lib4) | 3 |
| 1538 | High Met Breast (lib3) > Low Met Breast (lib4) | 20 |
| 1538 | HMEC-VEGF (lib14) > HMEC (lib12) | 2 |
| 1538 | HMEC-bFGF (lib13) > HMEC (lib12) | 2 |

Key for Table 19:
High Met = high metastatic potential;
Low Met = low metastatic potential;
met = metastasized;
tumor = non-metastasized tumor;
HMEC = human microvascular endothelial cell;
bFGF = bFGF treated;
VEGF = VEGF treated.

Example 14

Identification of Contiguous Sequences Having a Polynucleotide of the Invention

The novel polynucleotides were used to screen publicly available and proprietary databases to determine if any of the polynucleotides of SEQ ID NOS:2611–2707 would facilitate identification of a contiguous sequence, e.g., the polynucleotides would provide sequence that would result in 5' extension of another DNA sequence, resulting in production of a longer contiguous sequence composed of the provided polynucleotide and the other DNA sequence(s). Contiging was performed using the Gelmerge application (default settings) of GCG from the Univ. of Wisconsin.

Using these parameters, 97 contiged sequences were generated. These contiged sequences are provided as SEQ ID NOS:2611–2707 (see Table 1C). Table 1C provides the SEQ ID NO of the contig sequence, the name of the sequence used to create the contig, and the accession number of the publicly available tentative human consensus (THC) sequence used with the sequence of the corresponding sequence name to provide the contig. The sequence name of Table 1C can be correlated with the SEQ ID NO: of the polynucleotide of the invention using Tables 1A and 1B.

The contiged sequences (SEQ ID NOS:2611–2707) thus represent longer sequences that encompass a polynucleotide sequence of the invention. The contiged sequences were then translated in all three reading frames to determine the best alignment with individual sequences using the BLAST programs as described above. The sequences were masked using the XBLAST program for masking low complexity as described above in Example 1. Several of the contiged sequences were found to encode polypeptides having characteristics of a polypeptide belonging to a known protein families (and thus represent new members of these protein families) and/or comprising a known functional domain (Table 3B, inserted prior to claims). Thus the invention encompasses fragments, fusions, and variants of such polynucleotides that retain biological activity associated with the protein family and/or functional domain identified herein.

Descriptions of the profiles for the indicated protein families and functional domains are provided in Example 3 above. A description of the profile for PR55 is provided below.

Protein Phosphatase 2A Regulatory Subunit PR55 (PR55). Several of the contigs correspond to a sequence encoding a protein comprising a protein phosphatase 2A (PP2A) regulatory subunit PR55. PP2A is a serine/threonine phosphatase involved in many aspects of cellular function including the regulation of metabolic enzymes and proteins involved in signal transduction. PP2A is a trimeric enzyme comprising a core composed of a catalytic subunit associated with a 65 Kd regulatory subunit (PR65, also called subunit A). This complex associates with a third variable subunit (subunit B), which confers distinct properties to the holoenzyme (Mayer-Jaekel et al. Trends Cell Biol. (1994) 4:287–291). One of the forms of the variable subunit is a 55 Kd protein (PR55) which is highly conserved in mammals and may facilitate substrate recognition or targeting the enzyme complex to the appropriate subcellular compartment. The PR55 subunit comprises two conserved sequences of 15 residues; one located in the N-terminal region, the other in the center of the protein. The consensus patterns are: E-F-D-Y-L-K-S-L-E-I-E-E-K-I-N; and N-[AG]-H-[TA]-Y-H-I-N-S-I-S-[LIVM]-N-S-D.

Those skilled in the art will recognize, or be able to ascertain, using not more than routine experimentation, many equivalents to the specific embodiments of the invention described herein. Such specific embodiments and equivalents are intended to be encompassed by the following claims.

All publications and patent applications cited in this specification are herein incorporated by reference as if each individual publication or patent application were specifically and individually indicated to be incorporated by reference. The citation of any publication is for its disclosure prior to the filing date and should not be construed as an admission that the present invention is not entitled to antedate such publication by virtue of prior invention.

Although the foregoing invention has been described in some detail by way of illustration and example for purposes of clarity of understanding, it is readily apparent to those of ordinary skill in the art in light of the teachings of this invention that certain changes and modifications may be made thereto without departing from the spirit or scope of the appended claims.

Deposit Information. The following materials were deposited with the American Type Culture Collection (CMCC= Chiron Master Culture Collection).

TABLE 20

Cell Lines Deposited with ATCC

| Cell Line | Deposit Date | ATCC Accession No. | CMCC Accession No. |
|---|---|---|---|
| KM12L4-A | Mar. 19, 1998 | CRL-12496 | 11606 |
| Km12C | May 15, 1998 | CRL-12533 | 11611 |
| MDA-MB-231 | May 15, 1998 | CRL-12532 | 10583 |
| MCF-7 | Oct. 9, 1998 | CRL-12584 | 10377 |

In addition, pools of selected clones, as well as libraries containing specific clones, were assigned an "ES" number (internal reference) and deposited with the ATCC. Table 21 below provides the ATCC Accession Nos. of the ES deposits, all of which were deposited on or before May 13, 1999. The names of the clones contained within each of these deposits are provided in the tables numbered 22 and greater (inserted before the claims).

TABLE 21

Pools of Clones and Libraries Deposited with ATCC on or before May 13, 1999

| ES # | ATCC Accession # | ES # | ATCC Accession # | ES # | ATCC Accession # |
|---|---|---|---|---|---|
| 34 | PTA-47 | 41 | PTA-52 | 48 | PTA-49 |
| 35 | PTA-57 | 42 | PTA-53 | 49 | PTA-66 |
| 36 | PTA-54 | 43 | PTA-62 | 50 | PTA-50 |

TABLE 21-continued

Pools of Clones and Libraries Deposited with ATCC on or before May 13, 1999

| ES # | ATCC Accession # | ES # | ATCC Accession # | ES # | ATCC Accession # |
|---|---|---|---|---|---|
| 37 | PTA-58 | 44 | PTA-55 | 51 | PTA-65 |
| 38 | PTA-48 | 45 | PTA-61 | 52 | PTA-46 |
| 39 | PTA-60 | 46 | PTA-64 | 53 | PTA-51 |
| 40 | PTA-63 | 47 | PTA-56 | 54 | PTA-59 |

The deposits described herein are provided merely as convenience to those of skill in the art, and is not an admission that a deposit is required under 35 U.S.C. § 112. The sequence of the polynucleotides contained within the deposited material, as well as the amino acid sequence of the polypeptides encoded thereby, are incorporated herein by reference and are controlling in the event of any conflict with the written description of sequences herein. A license may be required to make, use, or sell the deposited material, and no such license is granted hereby.

Retrieval of Individual Clones from Deposit of Pooled Clones. Where the ATCC deposit is composed of a pool of cDNA clones or a library of cDNA clones, the deposit was prepared by first transfecting each of the clones into separate bacterial cells. The clones in the pool or library were then deposited as a pool of equal mixtures in the composite deposit. Particular clones can be obtained from the composite deposit using methods well known in the art. For example, a bacterial cell containing a particular clone can be identified by isolating single colonies, and identifying colonies containing the specific clone through standard colony hybridization techniques, using an oligonucleotide probe or probes designed to specifically hybridize to a sequence of the clone insert (e.g., a probe based upon unmasked sequence of the encoded polynucleotide having the indicated SEQ ID NO). The probe should be designed to have a $T_m$ of approximately 80° C. (assuming 2° C. for each A or T and 4° C. for each G or C). Positive colonies can then be picked, grown in culture, and the recombinant clone isolated. Alternatively, probes designed in this manner can be used to PCR to isolate a nucleic acid molecule from the pooled clones according to methods well known in the art, e.g., by purifying the cDNA from the deposited culture pool, and using the probes in PCR reactions to produce an amplified product having the corresponding desired polynucleotide sequence.

TABLE 1A

Priority Appln Information

| SEQ ID NO: | Filed | Dkt No. | SEQ ID NO: | Sequence Name | Clone Name |
|---|---|---|---|---|---|
| 1 | May 14, 1998 | 1487 | 1 | RTA00000608F.d.17.1 | M00003981C:E04 |
| 2 | May 14, 1998 | 1487 | 2 | RTA00000589F.n.08.1 | M00004182D:H03 |
| 3 | May 14, 1998 | 1487 | 3 | RTA00000589F.p.06.1 | M00004223D:D07 |
| 4 | May 14, 1998 | 1487 | 4 | RTA00000597F.b.03.4 | M00003770D:C07 |
| 5 | May 14, 1998 | 1487 | 5 | RTA00000608F.k.12.1 | M00004029A:E01 |
| 6 | May 14, 1998 | 1487 | 6 | RTA00000585F.h.08.2 | M00001432B:H08 |
| 7 | May 14, 1998 | 1487 | 7 | RTA00000585F.h.14.2 | M00001433A:C07 |
| 8 | May 14, 1998 | 1487 | 8 | RTA00000609F.f.01.3 | M00004060C:A02 |
| 9 | May 14, 1998 | 1487 | 9 | RTA00000588F.j.01.3 | M00003835A:E03 |
| 10 | May 14, 1998 | 1487 | 10 | RTA00000596F.b.19.1 | M00001663C:C03 |
| 11 | May 14, 1998 | 1487 | 11 | RTA00000585F.m.18.1 | M00001444A:A09 |
| 12 | May 14, 1998 | 1487 | 12 | RTA00000596F.m.11.1 | M00003753C:B01 |
| 13 | May 14, 1998 | 1487 | 13 | RTA00000589F.k.05.1 | M00004133C:B02 |

TABLE 1A-continued

Priority Appln Information

| SEQ ID NO: | Filed | Dkt No. | SEQ ID NO: | Sequence Name | Clone Name |
|---|---|---|---|---|---|
| 14 | May 14, 1998 | 1487 | 14 | RTA00000589F.a.18.2 | M00003984C:F04 |
| 15 | May 14, 1998 | 1487 | 15 | RTA00000585F.g.19.2 | M00001431A:E05 |
| 16 | May 14, 1998 | 1487 | 16 | RTA00000595F.c 21.1 | M00001598C:D10 |
| 17 | May 14, 1998 | 1487 | 17 | RTA00000584F.n.20.1 | M00001406C:A11 |
| 18 | May 14, 1998 | 1487 | 18 | RTA00000611F.o.18.5 | M00004204A:D04 |
| 19 | May 14, 1998 | 1487 | 19 | RTA00000597F.f.23.1 | M00003787D:A06 |
| 20 | May 14, 1998 | 1487 | 20 | RTA00000585F.p.13.2 | M00001452B:H06 |
| 21 | May 14, 1998 | 1487 | 21 | RTA00000583F.f.06.1 | M00001348D:H08 |
| 22 | May 14, 1998 | 1487 | 22 | RTA00000585F.h.08.1 | M00001432B:H08 |
| 23 | May 14, 1998 | 1487 | 23 | RTA00000589F.n.10.1 | M00004184B:F11 |
| 24 | May 14, 1998 | 1487 | 24 | RTA00000614F.k.01.1 | M00004465C:B12 |
| 25 | May 14, 1998 | 1487 | 25 | RTA00000587F.p.24.1 | M00001584C:A03 |
| 26 | May 14, 1998 | 1487 | 26 | RTA00000587F.g.19.2 | M00001548C:A09 |
| 27 | May 14, 1998 | 1487 | 27 | RTA00000612F.c.12.2 | M00004222A:H10 |
| 28 | May 14, 1998 | 1487 | 28 | RTA00000589F.f.09.1 | M00004064A:B12 |
| 29 | May 14, 1998 | 1487 | 29 | RTA00000586F.k.02.1 | M00001490B:G04 |
| 30 | May 14, 1998 | 1487 | 30 | RTA00000609F.b.20.2 | M00004050A:F02 |
| 31 | May 14, 1998 | 1487 | 31 | RTA00000584F.m.13.1 | M00001402D:C07 |
| 32 | May 14, 1998 | 1487 | 32 | RTA00000614F.i.12.1 | M00004447D:D10 |
| 33 | May 14, 1998 | 1487 | 33 | RTA00000608F.m.14.1 | M00004035A:A10 |
| 34 | May 14, 1998 | 1487 | 34 | RTA00000608F.m.01.1 | M00004033C:D10 |
| 35 | May 14, 1998 | 1487 | 35 | RTA00000597F.o.18.1 | M00003819C:E04 |
| 36 | May 14, 1998 | 1487 | 36 | RTA00000584F.g.06.1 | M00001390A:C06 |
| 37 | May 14, 1998 | 1487 | 37 | RTA00000609F.a.07.2 | M00004046A:F04 |
| 38 | May 14, 1998 | 1487 | 38 | RTA00000607F.o.12.2 | M00003961C:G02 |
| 39 | May 14, 1998 | 1487 | 39 | RTA00000597F.p.17.1 | M00003821C:E04 |
| 40 | May 14, 1998 | 1487 | 40 | RTA00000609F.f.16.3 | M00004063C:B11 |
| 41 | May 14, 1998 | 1487 | 41 | RTA00000584F.o.04.1 | M00001407B:A08 |
| 42 | May 14, 1998 | 1487 | 42 | RTA00000608F.d.21.1 | M00003982A:G03 |
| 43 | May 14, 1998 | 1487 | 43 | RTA00000614F.b.23.1 | M00004389C:E01 |
| 44 | May 14, 1998 | 1487 | 44 | RTA00000612F.1.04.1 | M00004268C:F08 |
| 45 | May 14, 1998 | 1487 | 45 | RTA00000611F.n.20.3 | M00004200D:A07 |
| 46 | May 14, 1998 | 1487 | 46 | RTA00000608F.e.01.1 | M00003982B:C10 |
| 47 | May 14, 1998 | 1487 | 47 | RTA00000585F.k.21.1 | M00001439C:G06 |
| 48 | May 14, 1998 | 1487 | 48 | RTA00000589F.d.07.1 | M00004037B:A09 |
| 49 | May 14, 1998 | 1487 | 49 | RTA00000614F.j.07.1 | M00004460B:H09 |
| 50 | May 14, 1998 | 1487 | 50 | RTA00000614F.o.08.1 | M00004508B:G02 |
| 51 | May 14, 1998 | 1487 | 51 | RTA00000608F.e.11.1 | M00003983C:E07 |
| 52 | May 14, 1998 | 1487 | 52 | RTA00000589F.d.08.1 | M00004037B:B05 |
| 53 | May 14, 1998 | 1487 | 53 | RTA00000614F.1.09.1 | M00004491D:D07 |
| 54 | May 14, 1998 | 1487 | 54 | RTA00000607F.m.15.1 | M00003949B:D05 |
| 55 | May 14, 1998 | 1487 | 55 | RTA00000609F.p.17.1 | M00004093D:D09 |
| 56 | May 14, 1998 | 1487 | 56 | RTA00000583F.d.22.1 | M00001346B:G03 |
| 57 | May 14, 1998 | 1487 | 57 | RTA00000589F.h.07.1 | M00004081B:C11 |
| 58 | May 14, 1998 | 1487 | 58 | RTA00000611F.k.19.3 | M00004191B:G01 |
| 59 | May 14, 1998 | 1487 | 59 | RTA00000595F.p.10.1 | M00001654D:F06 |
| 60 | May 14, 1998 | 1487 | 60 | RTA00000609F.h.01.1 | M00004068D:B01 |
| 61 | May 14, 1998 | 1487 | 61 | RTA00000612F.g.24.2 | M00004244B:A02 |
| 62 | May 14, 1998 | 1487 | 62 | RTA00000608F.b.10.1 | M00003975B:H09 |
| 63 | May 14, 1998 | 1487 | 63 | RTA00000587F.j.12.1 | M00001555D:F11 |
| 64 | May 14, 1998 | 1487 | 64 | RTA00000610F.p.02.1 | M00004152C:E01 |
| 65 | May 14, 1998 | 1487 | 65 | RTA00000608F.f.15.2 | M00003987A:C07 |
| 66 | May 14, 1998 | 1487 | 66 | RTA00000614F.k.11.1 | M00004467D:F09 |
| 67 | May 14, 1998 | 1487 | 67 | RTA00000612F.b.10.2 | M00004216D:E10 |
| 68 | May 14, 1998 | 1487 | 68 | RTA00000606F.k.11.1 | M00003864B:A04 |
| 69 | May 14, 1998 | 1487 | 69 | RTA00000583F.g.18.1 | M00001352C:E01 |
| 70 | May 14, 1998 | 1487 | 70 | RTA00000585F.i.13.1 | M00001435A:F03 |
| 71 | May 14, 1998 | 1487 | 71 | RTA00000612F.g.11.2 | M00004240D:A07 |
| 72 | May 14, 1998 | 1487 | 72 | RTA00000607F.1.05.1 | M00003936C:F10 |
| 73 | May 14, 1998 | 1487 | 73 | RTA00000610F.a.11.1 | M00004097C:A03 |
| 74 | May 14, 1998 | 1487 | 74 | RTA00000596F.k.09.1 | M00003746B:E12 |
| 75 | May 14, 1998 | 1487 | 75 | RTA00000611F.d.11.1 | M00004169A:B11 |
| 76 | May 14, 1998 | 1487 | 76 | RTA00000588F.g.06.1 | M00003797D:E10 |
| 77 | May 14, 1998 | 1487 | 77 | RTA00000595F.n.15.1 | M00001648C:F06 |
| 78 | May 14, 1998 | 1487 | 78 | RTA00000584F.c.22.1 | M00001382C:C09 |
| 79 | May 14, 1998 | 1487 | 79 | RTA00000585F.1.17.1 | M00001441D:H05 |
| 80 | May 14, 1998 | 1487 | 80 | RTA00000608F.k.15.2 | M00004029C:B03 |
| 81 | May 14, 1998 | 1487 | 81 | RTA00000597F.g.14.1 | M00003789C:E03 |
| 82 | May 14, 1998 | 1487 | 82 | RTA00000588F.n.16.3 | M00003906C:H12 |
| 83 | May 14, 1998 | 1487 | 83 | RTA00000606F.o.14.1 | M00003886C:D10 |
| 84 | May 14, 1998 | 1487 | 84 | RTA00000608F.n.09.1 | M00004037A:A07 |
| 85 | May 14, 1998 | 1487 | 85 | RTA00000613F.h.06.1 | M00004329C:F11 |
| 86 | May 14, 1998 | 1487 | 86 | RTA00000587F.1.08.1 | M00001564C:D04 |

TABLE 1A-continued

Priority Appln Information

| SEQ ID NO: | Filed | Dkt No. | SEQ ID NO: | Sequence Name | Clone Name |
|---|---|---|---|---|---|
| 87 | May 14, 1998 | 1487 | 87 | RTA0000059OF.d.23.1 | M00004350B:F06 |
| 88 | May 14, 1998 | 1487 | 88 | RTA00000609F.i.24.2 | M00004073D:E01 |
| 89 | May 14, 1998 | 1487 | 89 | RTA00000614F.j.23.1 | M00004465C:B10 |
| 90 | May 14, 1998 | 1487 | 90 | RTA00000587F.p.15.1 | M00001582D:B10 |
| 91 | May 14, 1998 | 1487 | 91 | RTA00000640F.a.05.1 | M00004190A:A09 |
| 92 | May 14, 1998 | 1487 | 92 | RTA00000609F.k.01.2 | M00004077D:D10 |
| 93 | May 14, 1998 | 1487 | 93 | RTA00000589F.e.14.2 | M00004054D:D02 |
| 94 | May 14, 1998 | 1487 | 94 | RTA00000586F.a.13.1 | M00001455A:E09 |
| 95 | May 14, 1998 | 1487 | 95 | RTA00000590F.d.10.1 | M00004337D:G08 |
| 96 | May 14, 1998 | 1487 | 96 | RTA00000608F.i.18.1 | M00003998A:D03 |
| 97 | May 14, 1998 | 1487 | 97 | RTA00000608F.m.05.1 | M00004034A:E08 |
| 98 | May 14, 1998 | 1487 | 98 | RTA00000597F.p.10.1 | M00003820D:E02 |
| 99 | May 14, 1998 | 1487 | 99 | RTA00000585F.n.20.1 | M00001446D:B10 |
| 100 | May 14, 1998 | 1487 | 100 | RTA00000584F.a.14.1 | M00001377A:D03 |
| 101 | May 14, 1998 | 1487 | 101 | RTA00000609F.p.03.2 | M00004092A:C03 |
| 102 | May 14, 1998 | 1487 | 102 | RTA00000606F.f.06.1 | M00003841A:E09 |
| 103 | May 14, 1998 | 1487 | 103 | RTA00000609F.o.22.1 | M00004091D:D09 |
| 104 | May 14, 1998 | 1487 | 104 | RTA00000587F.d.02.1 | M00001537B:C12 |
| 105 | May 14, 1998 | 1487 | 105 | RTA00000612F.n.07.2 | M00004277C:H11 |
| 106 | May 14, 1998 | 1487 | 106 | RTA00000606F.p.03.1 | M00003888C:E01 |
| 107 | May 14, 1998 | 1487 | 107 | RTA00000589F.g.15.1 | M00004076D:B03 |
| 108 | May 14, 1998 | 1487 | 108 | RTA00000610F.b.09.1 | M00004102C:F07 |
| 109 | May 14, 1998 | 1487 | 109 | RTA00000603F.a.13.1 | M00003820C:A09 |
| 110 | May 14, 1998 | 1487 | 110 | RTA00000606F.o.01.1 | M00003883D:C03 |
| 111 | May 14, 1998 | 1487 | 111 | RTA00000589F.c.17.1 | M00004030B:C05 |
| 112 | May 14, 1998 | 1487 | 112 | RTA00000589F.k.22.1 | M00004140B:B01 |
| 113 | May 14, 1998 | 1487 | 113 | RTA00000585F.k.08.1 | M00001438C:H05 |
| 114 | May 14, 1998 | 1487 | 114 | RTA00000595F.a.09.1 | M00001586A:F09 |
| 115 | May 14, 1998 | 1487 | 115 | RTA00000597F.g.22.1 | M00003790B:F12 |
| 116 | May 14, 1998 | 1487 | 116 | RTA00000597F.c.02.3 | M00003773A:C09 |
| 117 | May 14, 1998 | 1487 | 117 | RTA00000587F.b.18.1 | M00001530A:D11 |
| 118 | May 14, 1998 | 1487 | 118 | RTA00000606F.a.18.1 | M00003824B:D06 |
| 119 | May 14, 1998 | 1487 | 119 | RTA00000612F.j.14.2 | M00004260A:B07 |
| 120 | May 14, 1998 | 1487 | 120 | RTA00000612F.g.23.3 | M00004243C:E10 |
| 121 | May 14, 1998 | 1487 | 121 | RTA00000583F.p.05.1 | M00001374C:C09 |
| 122 | May 14, 1998 | 1487 | 122 | RTA00000586F.a.12.1 | M00001455A:C03 |
| 123 | May 14, 1998 | 1487 | 123 | RTA00000613F.d.21.1 | M00004308A:E06 |
| 124 | May 14, 1998 | 1487 | 124 | RTA00000586F.e.02.2 | M00001466C:F02 |
| 125 | May 14, 1998 | 1487 | 125 | RTA00000595F.f.07.1 | M00001609A:B12 |
| 126 | May 14, 1998 | 1487 | 126 | RTA00000607F.o.13.2 | M00003962B:B09 |
| 127 | May 14, 1998 | 1487 | 127 | RTA00000595F.b.06.1 | M00001590D:A07 |
| 128 | May 14, 1998 | 1487 | 128 | RTA00000609F.l.04.2 | M00004081C:A01 |
| 129 | May 14, 1998 | 1487 | 129 | RTA00000610F.b.08.1 | M00004102B:B04 |
| 130 | May 14, 1998 | 1487 | 130 | RTA00000585F.k.06.1 | M00001438B:H06 |
| 131 | May 14, 1998 | 1487 | 131 | RTA00000611F.o.20.5 | M00004204B:A04 |
| 132 | May 14, 1998 | 1487 | 132 | RTA00000614F.g.09.1 | M00004421A:G04 |
| 133 | May 14, 1998 | 1487 | 133 | RTA00000597F.h.12.1 | M00003793C:D11 |
| 134 | May 14, 1998 | 1487 | 134 | RTA00000597F.p.21.1 | M00003822A:G05 |
| 135 | May 14, 1998 | 1487 | 135 | RTA00000595F.l.24.2 | M00001641B:G05 |
| 136 | May 14, 1998 | 1487 | 136 | RTA00000584F.l.05.1 | M00001399C:E10 |
| 137 | May 14, 1998 | 1487 | 137 | RTA00000586F.j.16.1 | M00001489B:F08 |
| 138 | May 14, 1998 | 1487 | 138 | RTA00000613F.h.20.1 | M00004332B:E11 |
| 139 | May 14, 1998 | 1487 | 139 | RTA00000606F.k.06.1 | M00003862C:H10 |
| 140 | May 14, 1998 | 1487 | 140 | RTA00000587F.j.01.1 | M00001557C:B08 |
| 141 | May 14, 1998 | 1487 | 141 | RTA00000610F.l.23.1 | M00004143A:H07 |
| 142 | May 14, 1998 | 1487 | 142 | RTA00000606F.j.21.1 | M00003860B:A07 |
| 143 | May 14, 1998 | 1487 | 143 | RTA00000608F.j.15.1 | M00003997D:D07 |
| 144 | May 14, 1998 | 1487 | 144 | RTA00000596F.o.21.1 | M00003763D:F06 |
| 145 | May 14, 1998 | 1487 | 145 | RTA00000597F.l.05.1 | M00003809B:D08 |
| 146 | May 14, 1998 | 1487 | 146 | RTA00000608F.h.04.1 | M00003992D:G01 |
| 147 | May 14, 1998 | 1487 | 147 | RTA00000585F.d.21.1 | M00001424A:H09 |
| 148 | May 14, 1998 | 1487 | 148 | RTA00000606F.k.15.1 | M00003864C:D09 |
| 149 | May 14, 1998 | 1487 | 149 | RTA00000612F.k.16.2 | M00004266A:F10 |
| 150 | May 14, 1998 | 1487 | 150 | RTA00000589F.b.14.1 | M00003991B:B05 |
| 151 | May 14, 1998 | 1487 | 151 | RTA00000597F.m.17.1 | M00003813D:A06 |
| 152 | May 14, 1998 | 1487 | 152 | RTA00000585F.k.14.1 | M00001439B:E02 |
| 153 | May 14, 1998 | 1487 | 153 | RTA00000584F.f.21.1 | M00001389B:B06 |
| 154 | May 14, 1998 | 1487 | 154 | RTA00000597F.i.09.1 | M00003796C:H03 |
| 155 | May 14, 1998 | 1487 | 155 | RTA00000597F.h.20.1 | M00003795A:B01 |
| 156 | May 14, 1998 | 1487 | 156 | RTA00000608F.k.24.1 | M00004030B:B02 |
| 157 | May 14, 1998 | 1487 | 157 | RTA00000586F.n.05.1 | M00001500B:H07 |
| 158 | May 14, 1998 | 1487 | 158 | RTA00000608F.n.02.1 | M00004035D:E04 |
| 159 | May 14, 1998 | 1487 | 159 | RTA00000585F.e.11.2 | M00001425C:E10 |

TABLE 1A-continued

Priority Appln Information

| SEQ ID NO: | Filed | Dkt No. | SEQ ID NO: | Sequence Name | Clone Name |
|---|---|---|---|---|---|
| 160 | May 14, 1998 | 1487 | 160 | RTA00000596F.k.08.1 | M00003746A:E01 |
| 161 | May 14, 1998 | 1487 | 161 | RTA00000611F.b.14.1 | M00004163A:D11 |
| 162 | May 14, 1998 | 1487 | 162 | RTA00000607F.m.10.1 | M00003948B:B03 |
| 163 | May 14, 1998 | 1487 | 163 | RTA00000586F.p.01.1 | M00001506A:F01 |
| 164 | May 14, 1998 | 1487 | 164 | RTA00000589F.g.08.1 | M00004075C:C09 |
| 165 | May 14, 1998 | 1487 | 165 | RTA00000608F.n.19.1 | M00004037D:B05 |
| 166 | May 14, 1998 | 1487 | 166 | RTA00000607F.c.16.2 | M00003905C:B01 |
| 167 | May 14, 1998 | 1487 | 167 | RTA00000595F.j.09.1 | M00001622C:F06 |
| 168 | May 14, 1998 | 1487 | 168 | RTA00000584F.j.10.1 | M00001397B:E02 |
| 169 | May 14, 1998 | 1487 | 169 | RTA00000589F.i.13.1 | M00004103B:C07 |
| 170 | May 14, 1998 | 1487 | 170 | RTA00000585F.f.04.2 | M00001427A:C05 |
| 171 | May 14, 1998 | 1487 | 171 | RTA00000606F.d.24.1 | M00003837C:F05 |
| 172 | May 14, 1998 | 1487 | 172 | RTA00000609F.n.22.1 | M00004088A:F12 |
| 173 | May 14, 1998 | 1487 | 173 | RTA00000610F.m.14.1 | M00004144D:B06 |
| 174 | May 14, 1998 | 1487 | 174 | RTA00000606F.k.17.1 | M00003864D:G05 |
| 175 | May 14, 1998 | 1487 | 175 | RTA00000583F.d.06.1 | M00001345A:A12 |
| 176 | May 14, 1998 | 1487 | 176 | RTA00000608F.m.09.1 | M00004034C:F05 |
| 177 | May 14, 1998 | 1487 | 177 | RTA00000608F.o.17.1 | M00004040D:B05 |
| 178 | May 14, 1998 | 1487 | 178 | RTA00000583F.k.15.3 | M00001362B:H09 |
| 179 | May 14, 1998 | 1487 | 179 | RTA00000610F.f.16.1 | M00004120A:C02 |
| 180 | May 14, 1998 | 1487 | 180 | RTA00000608F.h.19.2 | M00003994C:C11 |
| 181 | May 14, 1998 | 1487 | 181 | RTA00000584F.m.07.1 | M00001401D:D04 |
| 182 | May 14, 1998 | 1487 | 182 | RTA00000587F.h.20.2 | M00001552B:D01 |
| 183 | May 14, 1998 | 1487 | 183 | RTA00000596F.b.01.1 | M00001660A:F10 |
| 184 | May 14, 1998 | 1487 | 184 | RTA00000611F.n.13.2 | M00004199D:C02 |
| 185 | May 14, 1998 | 1487 | 185 | RTA00000597F.o.06.1 | M00003818A:F09 |
| 186 | May 14, 1998 | 1487 | 186 | RTA00000589F.n.03.1 | M00004178B:F06 |
| 187 | May 14, 1998 | 1487 | 187 | RTA00000597F.k.07.1 | M00003805A:G05 |
| 188 | May 14, 1998 | 1487 | 188 | RTA00000611F.c.19.2 | M00004166B:E10 |
| 189 | May 14, 1998 | 1487 | 189 | RTA00000606F.l.12.1 | M00003868D:F02 |
| 190 | May 14, 1998 | 1487 | 190 | RTA00000614F.d.22.1 | M00004407D:B09 |
| 191 | May 14, 1998 | 1487 | 191 | RTA00000608F.n.16.1 | M00004037C:D07 |
| 192 | May 14, 1998 | 1487 | 192 | RTA00000595F.l.20.2 | M00001640D:C10 |
| 193 | May 14, 1998 | 1487 | 193 | RTA00000608F.k.22.1 | M00004030A:E09 |
| 194 | May 14, 1998 | 1487 | 194 | RTA00000583F.h.23.1 | M00001355B:A01 |
| 195 | May 14, 1998 | 1487 | 195 | RTA00000608F.c.23.1 | M00003980C:A11 |
| 196 | May 14, 1998 | 1487 | 196 | RTA00000585F.n.01.1 | M00001444A:G12 |
| 197 | May 14, 1998 | 1487 | 197 | RTA00000596F.n.08.1 | M00003756C:C08 |
| 198 | May 14, 1998 | 1487 | 198 | RTA00000612F.d.16.2 | M00004229C:G11 |
| 199 | May 14, 1998 | 1487 | 199 | RTA00000589F.c.19.1 | M00004031A:B04 |
| 200 | May 14, 1998 | 1487 | 200 | RTA00000584F.j.08.1 | M00001397A:F10 |
| 201 | May 14, 1998 | 1487 | 201 | RTA00000583F.j.03.3 | M00001358D:D09 |
| 202 | May 14, 1998 | 1487 | 202 | RTA00000597F.j.09.1 | M00003801D:F05 |
| 203 | May 14, 1998 | 1487 | 203 | RTA00000614F.n.21.1 | M00004506C:H10 |
| 204 | May 14, 1998 | 1487 | 204 | RTA00000606F.d.05.1 | M00003833B:A11 |
| 205 | May 14, 1998 | 1487 | 205 | RTA00000589F.d.10.1 | M00004038C:D12 |
| 206 | May 14, 1998 | 1487 | 206 | RTA00000597F.p.01.1 | M00003820A:H04 |
| 207 | May 14, 1998 | 1487 | 207 | RTA00000586F.l.20.1 | M00001496A:B03 |
| 208 | May 14, 1998 | 1487 | 208 | RTA00000607F.c.07.2 | M00003903C:A12 |
| 209 | May 14, 1998 | 1487 | 209 | RTA00000595F.b.02.1 | M00001589C:D12 |
| 210 | May 14, 1998 | 1487 | 210 | RTA00000597F.n.18.1 | M00003816C:F10 |
| 211 | May 14, 1998 | 1487 | 211 | RTA00000612F.d.10.2 | M00004228C:D11 |
| 212 | May 14, 1998 | 1487 | 212 | RTA00000609F.n.13.1 | M00004086D:A07 |
| 213 | May 14, 1998 | 1487 | 213 | RTA00000610F.b.02.1 | M00004101D:A03 |
| 214 | May 14, 1998 | 1487 | 214 | RTA00000590F.a.17.1 | M00004249C:E12 |
| 215 | May 14, 1998 | 1487 | 215 | RTA00000587F.i.02.1 | M00001553D:B06 |
| 216 | May 14, 1998 | 1487 | 216 | RTA00000583F.p.22.1 | M00001376A:H02 |
| 217 | May 14, 1998 | 1487 | 217 | RTA00000609F.d.08.1 | M00004054D:A03 |
| 218 | May 14, 1998 | 1487 | 218 | RTA00000609F.k.06.2 | M00004078C:A08 |
| 219 | May 14, 1998 | 1487 | 219 | RTA00000585F.i.20.1 | M00001435B:G10 |
| 220 | May 14, 1998 | 1487 | 220 | RTA00000585F.e.15.2 | M00001426A:F09 |
| 221 | May 14, 1998 | 1487 | 221 | RTA00000595F.c.18.1 | M00001597C:B03 |
| 222 | May 14, 1998 | 1487 | 222 | RTA00000596F.p.18.1 | M00003766A:G09 |
| 223 | May 14, 1998 | 1487 | 223 | RTA00000611F.l.04.3 | M00004193A:C07 |
| 224 | May 14, 1998 | 1487 | 224 | RTA00000614F.o.06.1 | M00004508A:G12 |
| 225 | May 14, 1998 | 1487 | 225 | RTA00000586F.o.13.1 | M00001504D:D09 |
| 226 | May 14, 1998 | 1487 | 226 | RTA00000612F.o.21.1 | M00004283C:D03 |
| 227 | May 14, 1998 | 1487 | 227 | RTA00000585F.k.18.1 | M00001439C:A01 |
| 228 | May 14, 1998 | 1487 | 228 | RTA00000611F.o.19.5 | M00004204A:D10 |
| 229 | May 14, 1998 | 1487 | 229 | RTA00000611F.l.10.3 | M00004193C:H01 |
| 230 | May 14, 1998 | 1487 | 230 | RTA00000612F.b.22.2 | M00004217D:G10 |
| 231 | May 14, 1998 | 1487 | 231 | RTA00000583F.n.06.1 | M00001370B:B12 |
| 232 | May 14, 1998 | 1487 | 232 | RTA00000611F.p.08.3 | M00004206C:G11 |

TABLE 1A-continued

Priority Appln Information

| SEQ ID NO: | Filed | Dkt No. | SEQ ID NO: | Sequence Name | Clone Name |
|---|---|---|---|---|---|
| 233 | May 14, 1998 | 1487 | 233 | RTA00000607F.e.03.2 | M00003909D:G01 |
| 234 | May 14, 1998 | 1487 | 234 | RTA00000607F.b.09.2 | M00003896D:B01 |
| 235 | May 14, 1998 | 1487 | 235 | RTA00000585F.j.16.1 | M00001436D:C10 |
| 236 | May 14, 1998 | 1487 | 236 | RTA00000607F.g.05.2 | M00003915C:G01 |
| 237 | May 14, 1998 | 1487 | 237 | RTA00000586F.o.14.1 | M00001505A:E09 |
| 238 | May 14, 1998 | 1487 | 238 | RTA00000607F.h.15.1 | M00003920B:A10 |
| 239 | May 14, 1998 | 1487 | 239 | RTA00000586F.m.14.1 | M00001499B:H05 |
| 240 | May 14, 1998 | 1487 | 240 | RTA00000610F.p.17.1 | M00004154D:F11 |
| 241 | May 14, 1998 | 1487 | 241 | RTA00000584F.d.11.1 | M00001383C:C07 |
| 242 | May 14, 1998 | 1487 | 242 | RTA00000610F.e.07.1 | M00004114C:F02 |
| 243 | May 14, 1998 | 1487 | 243 | RTA00000610F.b.17.1 | M00004103B:C09 |
| 244 | May 14, 1998 | 1487 | 244 | RTA00000596F.c.05.1 | M00001669A:H11 |
| 245 | May 14, 1998 | 1487 | 245 | RTA00000586F.b.17.1 | M00001458B:F06 |
| 246 | May 14, 1998 | 1487 | 246 | RTA00000607F.l.16.1 | M00003939A:A02 |
| 247 | May 14, 1998 | 1487 | 247 | RTA00000590F.f.18.2 | M00004446A:G01 |
| 248 | May 14, 1998 | 1487 | 248 | RTA00000603F.b.07.1 | M00004242C:C01 |
| 249 | May 14, 1998 | 1487 | 249 | RTA00000589F.f.11.1 | M00004066A:E12 |
| 250 | May 14, 1998 | 1487 | 250 | RTA00000589F.j.09.1 | M00004115A:G09 |
| 251 | May 14, 1998 | 1487 | 251 | RTA00000583F.a.18.1 | M00001339B:E05 |
| 252 | May 14, 1998 | 1487 | 252 | RTA00000612F.f.23.3 | M00004239C:C09 |
| 253 | May 14, 1998 | 1487 | 253 | RTA00000597F.0.12.1 | M00003818C:E09 |
| 254 | May 14, 1998 | 1487 | 254 | RTA00000607F.b.05.2 | M00003896B:F08 |
| 255 | May 14, 1998 | 1487 | 255 | RTA00000607F.e.23.2 | M00003912C:C11 |
| 256 | May 14, 1998 | 1487 | 256 | RTA00000586F.m.11.1 | M00001499A:D05 |
| 257 | May 14, 1998 | 1487 | 257 | RTA00000585F.g.18.2 | M00001431A:C10 |
| 258 | May 14, 1998 | 1487 | 258 | RTA00000614F.d.07.1 | M00004403A:B05 |
| 259 | May 14, 1998 | 1487 | 259 | RTA00000606F.c.23.1 | M00003832B:G03 |
| 260 | May 14, 1998 | 1487 | 260 | RTA00000609F.d.13.1 | M00004055B:F06 |
| 261 | May 14, 1998 | 1487 | 261 | RTA00000606F.c.04.1 | M00003829A:E02 |
| 262 | May 14, 1998 | 1487 | 262 | RTA00000587F.f.02.1 | M00001542C:F06 |
| 263 | May 14, 1998 | 1487 | 263 | RTA00000585F.e.14.2 | M00001426A:C02 |
| 264 | May 14, 1998 | 1487 | 264 | RTA00000584F.o.03.2 | M00001406D:H01 |
| 265 | May 14, 1998 | 1487 | 265 | RTA00000614F.m.24.1 | M00004501A:G06 |
| 266 | May 14, 1998 | 1487 | 266 | RTA00000586F.j.21.1 | M00001489D:C08 |
| 267 | May 14, 1998 | 1487 | 267 | RTA00000585F.d.02.2 | M00001421C:A03 |
| 268 | May 14, 1998 | 1487 | 268 | RTA00000597F.o.19.1 | M00003819D:G09 |
| 269 | May 14, 1998 | 1487 | 269 | RTA00000613F.h.02.1 | M00004328A:H06 |
| 270 | May 14, 1998 | 1487 | 270 | RTA00000612F.m.08.2 | M00004273D:E11 |
| 271 | May 14, 1998 | 1487 | 271 | RTA00000606F.g.04.1 | M00003844C:H05 |
| 272 | May 14, 1998 | 1487 | 272 | RTA00000608F.h.04.2 | M00003992D:G01 |
| 273 | May 14, 1998 | 1487 | 273 | RTA00000609F.e.19.3 | M00004059A:G09 |
| 274 | May 14, 1998 | 1487 | 274 | RTA00000613F.c.10.1 | M00004297D:B08 |
| 275 | May 14, 1998 | 1487 | 275 | RTA00000587F.d.24.1 | M00001539B:B01 |
| 276 | May 14, 1998 | 1487 | 276 | RTA00000597F.a.22.5 | M00003769D:G12 |
| 277 | May 14, 1998 | 1487 | 277 | RTA00000595F.m.11.1 | M00001644D:F09 |
| 278 | May 14, 1998 | 1487 | 278 | RTA00000613F.k.05.1 | M00004346B:D06 |
| 279 | May 14, 1998 | 1487 | 279 | RTA00000611F.n.15.2 | M00004200A:G06 |
| 280 | May 14, 1998 | 1487 | 280 | RTA00000609F.m.20.2 | M00004085B:G06 |
| 281 | May 14, 1998 | 1487 | 281 | RTA00000609F.c.08.1 | M00004051C:D10 |
| 282 | May 14, 1998 | 1487 | 282 | RTA00000586F.k.13.1 | M00001491C:C01 |
| 283 | May 14, 1998 | 1487 | 283 | RTA00000595F.i.16.1 | M00001623D:A09 |
| 284 | May 14, 1998 | 1487 | 284 | RTA00000588F.j.17.3 | M00003839D:G06 |
| 285 | May 14, 1998 | 1487 | 285 | RTA00000610F.j.05.1 | M00004129A:H08 |
| 286 | May 14, 1998 | 1487 | 286 | RTA00000596F.o.14.1 | M00003762A:D11 |
| 287 | May 14, 1998 | 1487 | 287 | RTA00000583F.e.15.1 | M00001347B:H01 |
| 288 | May 14, 1998 | 1487 | 288 | RTA00000584F.a.01.2 | M00001376B:C11 |
| 289 | May 14, 1998 | 1487 | 289 | RTA00000597F.c.10.4 | M00003773D:C02 |
| 290 | May 14, 1998 | 1487 | 290 | RTA00000595F.d.20.1 | M00001604B:D09 |
| 291 | May 14, 1998 | 1487 | 291 | RTA00000609F.m.04.2 | M00004084A:D11 |
| 292 | May 14, 1998 | 1487 | 292 | RTA00000589F.b.08.1 | M00003988C:A06 |
| 293 | May 14, 1998 | 1487 | 293 | RTA00000583F.k.13.3 | M00001362B:A09 |
| 294 | May 14, 1998 | 1487 | 294 | RTA00000606F.b.07.1 | M00003825C:B02 |
| 295 | May 14, 1998 | 1487 | 295 | RTA00000583F.a.17.1 | M00001339B:A03 |
| 296 | May 14, 1998 | 1487 | 296 | RTA00000611F.o.09.5 | M00004201D:E12 |
| 297 | May 14, 1998 | 1487 | 297 | RTA00000610F.j.15.1 | M00004134C:B11 |
| 298 | May 14, 1998 | 1487 | 298 | RTA00000608F.e.21.1 | M00003985A:C01 |
| 299 | May 14, 1998 | 1487 | 299 | RTA00000614F.k.08.1 | M00004467A:F09 |
| 300 | May 14, 1998 | 1487 | 300 | RTA00000610F.p.11.1 | M00004153D:E06 |
| 301 | May 14, 1998 | 1487 | 301 | RTA00000595F.l.14.1 | M00001639A:A04 |
| 302 | May 14, 1998 | 1487 | 302 | RTA00000596F.m.03.1 | M00003752A:B06 |
| 303 | May 14, 1998 | 1487 | 303 | RTA00000595F.n.06.2 | M00001647C:C07 |
| 304 | May 14, 1998 | 1487 | 304 | RTA00000596F.e.22.2 | M00001679C:F03 |
| 305 | May 14, 1998 | 1487 | 305 | RTA00000607F.c.18.2 | M00003905C:E10 |

TABLE 1A-continued

Priority Appln Information

| SEQ ID NO: | Filed | Dkt No. | SEQ ID NO: | Sequence Name | Clone Name |
|---|---|---|---|---|---|
| 306 | May 14, 1998 | 1487 | 306 | RTA00000597F.o.15.1 | M00003819A:B09 |
| 307 | May 14, 1998 | 1487 | 307 | RTA00000584F.f.10.1 | M00001387D:C07 |
| 308 | May 14, 1998 | 1487 | 308 | RTA00000597F.b.07.5 | M00003771A:G09 |
| 309 | May 14, 1998 | 1487 | 309 | RTA00000584F.m.17.1 | M00001403B:A01 |
| 310 | May 14, 1998 | 1487 | 310 | RTA00000608F.g.08.2 | M00003989C:F01 |
| 311 | May 14, 1998 | 1487 | 311 | RTA00000587F.o.03.1 | M00001575A:H02 |
| 312 | May 14, 1998 | 1487 | 312 | RTA00000597F.m.10.1 | M00003812D:E08 |
| 313 | May 14, 1998 | 1487 | 313 | RTA00000596F.1.10.1 | M00003749D:G07 |
| 314 | May 14, 1998 | 1487 | 314 | RTA00000584F.h.08.1 | M00001391D:A07 |
| 315 | May 14, 1998 | 1487 | 315 | RTA00000587F.f.07.1 | M00001543A:F01 |
| 316 | May 14, 1998 | 1487 | 316 | RTA00000595F.b.04.1 | M00001589D:G10 |
| 317 | May 14, 1998 | 1487 | 317 | RTA00000590F.d.17.1 | M00004345A:H06 |
| 318 | May 14, 1998 | 1487 | 318 | RTA00000612F.1.07.2 | M00004268D:G07 |
| 319 | May 14, 1998 | 1487 | 319 | RTA00000607F.e.15.2 | M00003911C:G05 |
| 320 | May 14, 1998 | 1487 | 320 | RTA00000614F.i.23.1 | M00004449D:H01 |
| 321 | May 14, 1998 | 1487 | 321 | RTA00000612F.1.08.2 | M00004269A:B11 |
| 322 | May 14, 1998 | 1487 | 322 | RTA00000608F.n.23.1 | M00004038C:C05 |
| 323 | May 14, 1998 | 1487 | 323 | RTA00000583F.e.11.1 | M00001347A:G06 |
| 324 | May 14, 1998 | 1487 | 324 | RTA00000612F.e.10.3 | M00004234B:E03 |
| 325 | May 14, 1998 | 1487 | 325 | RTA00000609F.0.20.1 | M00004091C:F04 |
| 326 | May 14, 1998 | 1487 | 326 | RTA00000583F.d.19.1 | M00001346B:A07 |
| 327 | May 14, 1998 | 1487 | 327 | RTA00000609F.o.16.2 | M00004091B:C12 |
| 328 | May 14, 1998 | 1487 | 328 | RTA00000586F.a.23.1 | M00001456C:F02 |
| 329 | May 14, 1998 | 1487 | 329 | RTA00000583F.j.04.3 | M00001359A:B07 |
| 330 | May 14, 1998 | 1487 | 330 | RTA00000585F.a.02.3 | M00001412D:C03 |
| 331 | May 14, 1998 | 1487 | 331 | RTA00000606F.o.02.1 | M00003884B:E06 |
| 332 | May 14, 1998 | 1487 | 332 | RTA00000609F.m.09.2 | M00004084C:G04 |
| 333 | May 14, 1998 | 1487 | 333 | RTA00000606F.b.10.1 | M00003826B:D01 |
| 334 | May 14, 1998 | 1487 | 334 | RTA00000596F.k.19.1 | M00003748B:B06 |
| 335 | May 14, 1998 | 1487 | 335 | RTA00000596F.o.17.1 | M00003763B:D03 |
| 336 | May 14, 1998 | 1487 | 336 | RTA00000611F.g.23.1 | M00004180B:F04 |
| 337 | May 14, 1998 | 1487 | 337 | RTA00000586F.m.05.1 | M00001496D:D02 |
| 338 | May 14, 1998 | 1487 | 338 | RTA00000612F.n.03.2 | M00004277B:C06 |
| 339 | May 14, 1998 | 1487 | 339 | RTA00000585F.b.18.3 | M00001417B:E01 |
| 340 | May 14, 1998 | 1487 | 340 | RTA00000606F.b.03.1 | M00003825B:A05 |
| 341 | May 14, 1998 | 1487 | 341 | RTA00000583F.n.05.1 | M00001370B:B04 |
| 342 | May 14, 1998 | 1487 | 342 | RTA00000607F.o.10.2 | M00003961B:A12 |
| 343 | May 14, 1998 | 1487 | 343 | RTA00000613F.c.13.1 | M00004297D:E08 |
| 344 | May 14, 1998 | 1487 | 344 | RTA00000595F.f.14.1 | M00001610B:A01 |
| 345 | May 14, 1998 | 1487 | 345 | RTA00000608F.a.10.3 | M00003973A:C05 |
| 346 | May 14, 1998 | 1487 | 346 | RTA00000609F.j.05.3 | M00004075A:G10 |
| 347 | May 14, 1998 | 1487 | 347 | RTA00000586F.d.01.1 | M00001463C:A01 |
| 348 | May 14, 1998 | 1487 | 348 | RTA00000612F.h.03.3 | M00004245A:G09 |
| 349 | May 14, 1998 | 1487 | 349 | RTA00000596F.e.18.2 | M00001678D:A12 |
| 350 | May 14, 1998 | 1487 | 350 | RTA00000606F.g.18.1 | M00003846B:H02 |
| 351 | May 14, 1998 | 1487 | 351 | RTA00000597F.c.07.4 | M00003773B:G08 |
| 352 | May 14, 1998 | 1487 | 352 | RTA00000610F.e.15.1 | M00004117B:F01 |
| 353 | May 14, 1998 | 1487 | 353 | RTA00000595F.h.07.1 | M00001618C:E06 |
| 354 | May 14, 1998 | 1487 | 354 | RTA00000597F.f.17.1 | M00003786D:C06 |
| 355 | May 14, 1998 | 1487 | 355 | RTA00000606F.l.10.1 | M00003868B:C07 |
| 356 | May 14, 1998 | 1487 | 356 | RTA00000586F.g.20.1 | M00001478A:B06 |
| 357 | May 14, 1998 | 1487 | 357 | RTA00000606F.b.05.1 | M00003825B:D12 |
| 358 | May 14, 1998 | 1487 | 358 | RTA00000588F.p.09.2 | M00003972B:A11 |
| 359 | May 14, 1998 | 1487 | 359 | RTA00000595F.d.05.1 | M00001599A:H09 |
| 360 | May 14, 1998 | 1487 | 360 | RTA00000587F.n.19.1 | M00001572C:E07 |
| 361 | May 14, 1998 | 1487 | 361 | RTA00000590F.a.02.1 | M00004240D:E06 |
| 362 | May 14, 1998 | 1487 | 362 | RTA00000587F.m.18.1 | M00001569B:F04 |
| 363 | May 14, 1998 | 1487 | 363 | RTA00000583F.k.09.3 | M00001362A:C10 |
| 364 | May 14, 1998 | 1487 | 364 | RTA00000608F.a.23.1 | M00003974B:A04 |
| 365 | May 14, 1998 | 1487 | 365 | RTA00000597F.e.22.1 | M00003784C:B09 |
| 366 | May 14, 1998 | 1487 | 366 | RTA00000583F.e.21.1 | M00001348A:G04 |
| 367 | May 14, 1998 | 1487 | 367 | RTA00000607F.e.20.2 | M00003912B:G11 |
| 368 | May 14, 1998 | 1487 | 368 | RTA00000614F.b.16.1 | M00004388C:D05 |
| 369 | May 14, 1998 | 1487 | 369 | RTA00000587F.b.03.1 | M00001518D:A10 |
| 370 | May 14, 1998 | 1487 | 370 | RTA00000609F.f.02.3 | M00004060C:A11 |
| 371 | May 14, 1998 | 1487 | 371 | RTA00000587F.c.20.1 | M00001536B:B11 |
| 372 | May 14, 1998 | 1487 | 372 | RTA00000612F.h.05.3 | M00004245C:A03 |
| 373 | May 14, 1998 | 1487 | 373 | RTA00000596F.j.13.1 | M00001693D:F07 |
| 374 | May 14, 1998 | 1487 | 374 | RTA00000585F.f.01.2 | M00001426D:D09 |
| 375 | May 14, 1998 | 1487 | 375 | RTA00000611F.m.07.3 | M00004196C:G05 |
| 376 | May 14, 1998 | 1487 | 376 | RTA00000606F.b.08.1 | M00003825C:B12 |
| 377 | May 14, 1998 | 1487 | 377 | RTA00000609F.b.10.2 | M00004048D:A07 |
| 378 | May 14, 1998 | 1487 | 378 | RTA00000609F.g.13.1 | M00004067C:D08 |

TABLE 1A-continued

Priority Appln Information

| SEQ ID NO: | Filed | Dkt No. | SEQ ID NO: | Sequence Name | Clone Name |
|---|---|---|---|---|---|
| 379 | May 14, 1998 | 1487 | 379 | RTA00000587F.l.11.1 | M00001565A:A02 |
| 380 | May 14, 1998 | 1487 | 380 | RTA00000608F.h.07.2 | M00003993A:E12 |
| 381 | May 14, 1998 | 1487 | 381 | RTA00000596F.m.21.1 | M00003754C:F01 |
| 382 | May 14, 1998 | 1487 | 382 | RTA00000586F.p.11.1 | M00001506D:A11 |
| 383 | May 14, 1998 | 1487 | 383 | RTA00000610F.c.01.1 | M00004104A:H09 |
| 384 | May 14, 1998 | 1487 | 384 | RTA00000597F.n.10.1 | M00003815C:A06 |
| 385 | May 14, 1998 | 1487 | 385 | RTA00000595F.c.14.1 | M00001597A:C07 |
| 386 | May 14, 1998 | 1487 | 386 | RTA00000586F.j.09.1 | M00001488B:G12 |
| 387 | May 14, 1998 | 1487 | 387 | RTA00000608F.l.20.1 | M00004032D:D03 |
| 388 | May 14, 1998 | 1487 | 388 | RTA00000613F.g.13.1 | M00004324B:D09 |
| 389 | May 14, 1998 | 1487 | 389 | RTA00000587F.j.21.1 | M00001561B:C10 |
| 390 | May 14, 1998 | 1487 | 390 | RTA00000583F.l.16.3 | M00001365D:H09 |
| 391 | May 14, 1998 | 1487 | 391 | RTA00000614F.d.16.1 | M00004406A:H03 |
| 392 | May 14, 1998 | 1487 | 392 | RTA00000610F.j.11.1 | M00004134A:F08 |
| 393 | May 14, 1998 | 1487 | 393 | RTA00000611F.j.11.1 | M00004188A:E05 |
| 394 | May 14, 1998 | 1487 | 394 | RTA00000609F.p.14.1 | M00004093A:F03 |
| 395 | May 14, 1998 | 1487 | 395 | RTA00000597F.l.18.1 | M00003811B:E07 |
| 396 | May 14, 1998 | 1487 | 396 | RTA00000585F.h.03.2 | M00001432A:F12 |
| 397 | May 14, 1998 | 1487 | 397 | RTA00000607F.h.23.1 | M00003920D:D09 |
| 398 | May 14, 1998 | 1487 | 398 | RTA00000607F.f.23.2 | M00003915B:G07 |
| 399 | May 14, 1998 | 1487 | 399 | RTA00000607F.f.18.2 | M00003915A:D09 |
| 400 | May 14, 1998 | 1487 | 400 | RTA00000609F.i.23.2 | M00004073D:B11 |
| 401 | May 14, 1998 | 1487 | 401 | RTA00000612F.f.05.3 | M00004236D:F04 |
| 402 | May 14, 1998 | 1487 | 402 | RTA00000597F.o.07.1 | M00003818B:A01 |
| 403 | May 14, 1998 | 1487 | 403 | RTA00000611F.o.06.5 | M00004201D:C11 |
| 404 | May 14, 1998 | 1487 | 404 | RTA00000589F.e.05.2 | M00004051C:D02 |
| 405 | May 14, 1998 | 1487 | 405 | RTA00000584F.o.07.1 | M00001407D:H11 |
| 406 | May 14, 1998 | 1487 | 406 | RTA00000608F.e.06.1 | M00003983A:D02 |
| 407 | May 14, 1998 | 1487 | 407 | RTA00000595F.a.22.1 | M00001588D:H08 |
| 408 | May 14, 1998 | 1487 | 408 | RTA00000611F.c.03.2 | M00004164D:D02 |
| 409 | May 14, 1998 | 1487 | 409 | RTA00000585F.c.03.2 | M00001418A:C02 |
| 410 | May 14, 1998 | 1487 | 410 | RTA00000611F.b.07.1 | M00004161B:A12 |
| 411 | May 14, 1998 | 1487 | 411 | RTA00000587F.g.09.2 | M00001546B:H01 |
| 412 | May 14, 1998 | 1487 | 412 | RTA00000611F.c.11.2 | M00004165C:E09 |
| 413 | May 14, 1998 | 1487 | 413 | RTA00000610F.c.18.1 | M00004108A:D04 |
| 414 | May 14, 1998 | 1487 | 414 | RTA00000611F.i.21.1 | M00004186B:E05 |
| 415 | May 14, 1998 | 1487 | 415 | RTA00000597F.e.11.1 | M00003782D:F04 |
| 416 | May 14, 1998 | 1487 | 416 | RTA00000586F.m.02.1 | M00001496C:H10 |
| 417 | May 14, 1998 | 1487 | 417 | RTA00000585F.b.20.3 | M00001417C:A09 |
| 418 | May 14, 1998 | 1487 | 418 | RTA00000606F.n.15.1 | M00003881D:D09 |
| 419 | May 14, 1998 | 1487 | 419 | RTA00000611F.h.17.2 | M00004183A:D06 |
| 420 | May 14, 1998 | 1487 | 420 | RTA00000609F.c.15.1 | M00004052C:A08 |
| 421 | May 14, 1998 | 1487 | 421 | RTA00000614F.m.10.1 | M00004497C:E09 |
| 422 | May 14, 1998 | 1487 | 422 | RTA00000612F.c.08.2 | M00004218D:F12 |
| 423 | May 14, 1998 | 1487 | 423 | RTA00000613F.h.22.1 | M00004332C:E09 |
| 424 | May 14, 1998 | 1487 | 424 | RTA00000587F.f.05.1 | M00001543A:D03 |
| 425 | May 14, 1998 | 1487 | 425 | RTA00000585F.k.04.1 | M00001438A:H10 |
| 426 | May 14, 1998 | 1487 | 426 | RTA00000585F.k.15.1 | M00001439B:F10 |
| 427 | May 14, 1998 | 1487 | 427 | RTA00000609F.p.04.1 | M00004092A:D04 |
| 428 | May 14, 1998 | 1487 | 428 | RTA00000585F.j.01.1 | M00001435C:H05 |
| 429 | May 14, 1998 | 1487 | 429 | RTA00000587F.a.20.1 | M00001517D:C03 |
| 430 | May 14, 1998 | 1487 | 430 | RTA00000609F.f.04.3 | M00004060D:A07 |
| 431 | May 14, 1998 | 1487 | 431 | RTA00000611F.k.13.2 | M00004190D:A10 |
| 432 | May 14, 1998 | 1487 | 432 | RTA00000586F.f.08.2 | M00001471C:G03 |
| 433 | May 14, 1998 | 1487 | 433 | RTA00000585F.i.14.1 | M00001435A:G01 |
| 434 | May 14, 1998 | 1487 | 434 | RTA00000614F.b.08.1 | M00004385C:B11 |
| 435 | May 14, 1998 | 1487 | 435 | RTA00000609F.o.04.2 | M00004089A:G03 |
| 436 | May 14, 1998 | 1487 | 436 | RTA00000583F.n.03.1 | M00001370A:B01 |
| 437 | May 14, 1998 | 1487 | 437 | RTA00000584F.j.05.1 | M00001396C:G02 |
| 438 | May 14, 1998 | 1487 | 438 | RTA00000608F.a.16.2 | M00003973B:H06 |
| 439 | May 14, 1998 | 1487 | 439 | RTA00000583F.b.15.1 | M00001341A:A11 |
| 440 | May 14, 1998 | 1487 | 440 | RTA00000596F.a.22.1 | M00001659D:G08 |
| 441 | May 14, 1998 | 1487 | 441 | RTA00000589F.c.15.1 | M00004030A:G12 |
| 442 | May 14, 1998 | 1487 | 442 | RTA00000610F.o.03.1 | M00004149B:H12 |
| 443 | May 14, 1998 | 1487 | 443 | RTA00000596F.e.06.2 | M00001677A:A12 |
| 444 | May 14, 1998 | 1487 | 444 | RTA00000607F.p.01.2 | M00003965A:F07 |
| 445 | May 14, 1998 | 1487 | 445 | RTA00000611F.c.16.2 | M00004166A:F02 |
| 446 | May 14, 1998 | 1487 | 446 | RTA00000611F.b.01.1 | M00004159D:H07 |
| 447 | May 14, 1998 | 1487 | 447 | RTA00000612F.b.12.2 | M00004217A:A11 |
| 448 | May 14, 1998 | 1487 | 448 | RTA00000584F.h.09.1 | M00001391D:A09 |
| 449 | May 14, 1998 | 1487 | 449 | RTA00000612F.g.18.3 | M00004242C:C02 |
| 450 | May 14, 1998 | 1487 | 450 | RTA00000609F.b.18.2 | M00004049D:G04 |
| 451 | May 14, 1998 | 1487 | 451 | RTA00000608F.f.17.1 | M00003987D:F06 |

TABLE 1A-continued

Priority Appln Information

| SEQ ID NO: | Filed | Dkt No. | SEQ ID NO: | Sequence Name | Clone Name |
|---|---|---|---|---|---|
| 452 | May 14, 1998 | 1487 | 452 | RTA00000589F.e.21.2 | M00004058B:F12 |
| 453 | May 14, 1998 | 1487 | 453 | RTA00000606F.j.07.1 | M00003857C:A03 |
| 454 | May 14, 1998 | 1487 | 454 | RTA00000610F.b.21.1 | M00004103C:F11 |
| 455 | May 14, 1998 | 1487 | 455 | RTA00000611F.c.22.2 | M00004166D:G07 |
| 456 | May 14, 1998 | 1487 | 456 | RTA00000583F.d.04.1 | M00001344D:G11 |
| 457 | May 14, 1998 | 1487 | 457 | RTA00000610F.h.08.1 | M00004126B:G02 |
| 458 | May 14, 1998 | 1487 | 458 | RTA00000596F.a.06.1 | M00001658B:C07 |
| 459 | May 14, 1998 | 1487 | 459 | RTA00000612F.o.10.2 | M00004281B:B05 |
| 460 | May 14, 1998 | 1487 | 460 | RTA00000610F.l.22.1 | M00004143A:G12 |
| 461 | May 14, 1998 | 1487 | 461 | RTA00000612F.o.09.2 | M00004281B:B03 |
| 462 | May 14, 1998 | 1487 | 462 | RTA00000596F.f.09.2 | M00001681A:H09 |
| 463 | May 14, 1998 | 1487 | 463 | RTA00000607F.p.13.2 | M00003970A:G10 |
| 464 | May 14, 1998 | 1487 | 464 | RTA00000610F.e.11.1 | M00004115C:H04 |
| 465 | May 14, 1998 | 1487 | 465 | RTA00000611F.b.02.1 | M00004160A:A01 |
| 466 | May 14, 1998 | 1487 | 466 | RTA00000608F.j.24.1 | M00004027C:H01 |
| 467 | May 14, 1998 | 1487 | 467 | RTA00000614F.k.22.1 | M00004470C:A02 |
| 468 | May 14, 1998 | 1487 | 468 | RTA00000612F.h.09.3 | M00004247A:E01 |
| 469 | May 14, 1998 | 1487 | 469 | RTA00000587F.f.01.1 | M00001542C:D10 |
| 470 | May 14, 1998 | 1487 | 470 | RTA00000608F.d.04.1 | M00003980C:G10 |
| 471 | May 14, 1998 | 1487 | 471 | RTA00000585F.m.16.2 | M00001443D:C03 |
| 472 | May 14, 1998 | 1487 | 472 | RTA00000613F.c.17.1 | M00004298B:D04 |
| 473 | May 14, 1998 | 1487 | 473 | RTA00000613F.h.19.1 | M00004332B:D02 |
| 474 | May 14, 1998 | 1487 | 474 | RTA00000609F.d.07.1 | M00004054B:G02 |
| 475 | May 14, 1998 | 1487 | 475 | RTA00000606F.0.17.1 | M00003887B:C03 |
| 476 | May 14, 1998 | 1487 | 476 | RTA00000585F.n.10.1 | M00001445B:E03 |
| 477 | May 14, 1998 | 1487 | 477 | RTA00000612F.p.04.2 | M00004284B:F07 |
| 478 | May 14, 1998 | 1487 | 478 | RTA00000589F.c.02.1 | M00003997B:H04 |
| 479 | May 14, 1998 | 1487 | 479 | RTA00000608F.p.16.1 | M00004044A:F08 |
| 480 | May 14, 1998 | 1487 | 480 | RTA00000597F.n.12.1 | M00003815D:D01 |
| 481 | May 14, 1998 | 1487 | 481 | RTA00000608F.l.10.1 | M00004031A:G05 |
| 482 | May 14, 1998 | 1487 | 482 | RTA00000606F.o.05.1 | M00003884D:A12 |
| 483 | May 14, 1998 | 1487 | 483 | RTA00000587F.j.05.1 | M00001558B:A12 |
| 484 | May 14, 1998 | 1487 | 484 | RTA00000584F.d.15.1 | M00001384A:C09 |
| 485 | May 14, 1998 | 1487 | 485 | RTA00000612F.n.22.1 | M00004279D:E02 |
| 486 | May 14, 1998 | 1487 | 486 | RTA00000585F.m.13.2 | M00001443D:A01 |
| 487 | May 14, 1998 | 1487 | 487 | RTA00000586F.m.22.1 | M00001500A:D09 |
| 488 | May 14, 1998 | 1487 | 488 | RTA00000608F.i.17.1 | M00003997D:G11 |
| 489 | May 14, 1998 | 1487 | 489 | RTA00000614F.k.04.1 | M00004466A:E09 |
| 490 | May 14, 1998 | 1487 | 490 | RTA00000608F.n.15.1 | M00004037C:C05 |
| 491 | May 14, 1998 | 1487 | 491 | RTA00000610F.m.06.1 | M00004143C:F08 |
| 492 | May 14, 1998 | 1487 | 492 | RTA00000585F.d.12.2 | M00001422D:D02 |
| 493 | May 14, 1998 | 1487 | 493 | RTA00000608F.b.19.1 | M00003976D:D12 |
| 494 | May 14, 1998 | 1487 | 494 | RTA00000596F.k.06.1 | M00003745C:E03 |
| 495 | May 14, 1998 | 1487 | 495 | RTA00000609F.o.14.2 | M00004091A:E01 |
| 496 | May 14, 1998 | 1487 | 496 | RTA00000607F.m.14.1 | M00003949B:A08 |
| 497 | May 14, 1998 | 1487 | 497 | RTA00000606F.f.08.1 | M00003841B:D05 |
| 498 | May 14, 1998 | 1487 | 498 | RTA00000583F.l.14.3 | M00001365D:D12 |
| 499 | May 14, 1998 | 1487 | 499 | RTA00000614F.g.04.1 | M00004419D:G01 |
| 500 | May 14, 1998 | 1487 | 500 | RTA00000610F.m.21.1 | M00004145C:A03 |
| 501 | May 14, 1998 | 1487 | 501 | RTA00000585F.d.16.1 | M00001423C:D06 |
| 502 | May 14, 1998 | 1487 | 502 | RTA00000588F.o.05.2 | M00003918C:E07 |
| 503 | May 14, 1998 | 1487 | 503 | RTA00000585F.b.04.3 | M00001415D:E12 |
| 504 | May 14, 1998 | 1487 | 504 | RTA00000588F.d.21.1 | M00001687C:A06 |
| 505 | May 14, 1998 | 1487 | 505 | RTA00000595F.g.16.1 | M00001614C:G04 |
| 506 | May 14, 1998 | 1487 | 506 | RTA00000612F.i.18.2 | M00004253B:F06 |
| 507 | May 14, 1998 | 1487 | 507 | RTA00000612F.e.12.1 | M00004234B:G06 |
| 508 | May 14, 1998 | 1487 | 508 | RTA00000583F.p.08.1 | M00001374D:D09 |
| 509 | May 14, 1998 | 1487 | 509 | RTA00000608F.b.04.1 | M00003974C:A05 |
| 510 | May 14, 1998 | 1487 | 510 | RTA00000596F.l.07.1 | M00003749B:C08 |
| 511 | May 14, 1998 | 1487 | 511 | RTA00000597F.l.02.1 | M00003809A:H12 |
| 512 | May 14, 1998 | 1487 | 512 | RTA00000595F.j.05.1 | M00001626C:C10 |
| 513 | May 14, 1998 | 1487 | 513 | RTA00000586F.k.18.1 | M00001491D:E07 |
| 514 | May 14, 1998 | 1487 | 514 | RTA00000608F.p.07.1 | M00004041D:E06 |
| 515 | May 14, 1998 | 1487 | 515 | RTA00000596F.m.07.1 | M00003752D:D09 |
| 516 | May 14, 1998 | 1487 | 516 | RTA00000588F.l.20.2 | M00003859C:B09 |
| 517 | May 14, 1998 | 1487 | 517 | RTA00000614F.a.20.1 | M00004383A:F02 |
| 518 | May 14, 1998 | 1487 | 518 | RTA00000597F.i.20.1 | M00003799B:D02 |
| 519 | May 14, 1998 | 1487 | 519 | RTA00000611F.n.143 | M00004200A:A09 |
| 520 | May 14, 1998 | 1487 | 520 | RTA00000586F.m.10.1 | M00001499A:D01 |
| 521 | May 14, 1998 | 1487 | 521 | RTA00000607F.i.06.4 | M00003921D:C06 |
| 522 | May 14, 1998 | 1487 | 522 | RTA00000585F.p.19.2 | M00001453B:F08 |
| 523 | May 14, 1998 | 1487 | 523 | RTA00000583F.c.06.1 | M00001342C:A04 |
| 524 | May 14, 1998 | 1487 | 524 | RTA00000595F.p.20.1 | M00001656D:F11 |

TABLE 1A-continued

Priority Appln Information

| SEQ ID NO: | Filed | Dkt No. | SEQ ID NO: | Sequence Name | Clone Name |
|---|---|---|---|---|---|
| 525 | May 14, 1998 | 1487 | 525 | RTA00000606F.g.02.1 | M00003844C:D04 |
| 526 | May 14, 1998 | 1487 | 526 | RTA00000606F.d.10.1 | M00003834A:A03 |
| 527 | May 14, 1998 | 1487 | 527 | RTA00000597F.f.21.1 | M00003787B:D07 |
| 528 | May 14, 1998 | 1487 | 528 | RTA00000613F.h.17.1 | M00004331D:H08 |
| 529 | May 14, 1998 | 1487 | 529 | RTA00000612F.h.19.3 | M00004249D:G02 |
| 530 | May 14, 1998 | 1487 | 530 | RTA00000589F.h.23.1 | M00004091B:G04 |
| 531 | May 14, 1998 | 1487 | 531 | RTA00000614F.e.06.1 | M00004408D:A10 |
| 532 | May 14, 1998 | 1487 | 532 | RTA00000612F.j.20.2 | M00004262C:C01 |
| 533 | May 14, 1998 | 1487 | 533 | RTA00000597F.m.07.1 | M00003812B:F08 |
| 534 | May 14, 1998 | 1487 | 534 | RTA00000589F.j.08.1 | M00004115A:F01 |
| 535 | May 14, 1998 | 1487 | 535 | RTA00000609F.g.16.1 | M00004068A:F02 |
| 536 | May 14, 1998 | 1487 | 536 | RTA00000587F.j.18.1 | M00001556D:A11 |
| 537 | May 14, 1998 | 1487 | 537 | RTA00000610F.c.05.1 | M00004104D:C09 |
| 538 | May 14, 1998 | 1487 | 538 | RTA00000607F.o.16.2 | M00003963B:D12 |
| 539 | May 14, 1998 | 1487 | 539 | RTA00000585F.i.08.1 | M00001434C:D05 |
| 540 | May 14, 1998 | 1487 | 540 | RTA00000584F.a.15.2 | M00001377A:E01 |
| 541 | May 14, 1998 | 1487 | 541 | RTA00000611F.p.24.2 | M00004210A:B09 |
| 542 | May 14, 1998 | 1487 | 542 | RTA00000607F.a.13.3 | M00003893C:D12 |
| 543 | May 14, 1998 | 1487 | 543 | RTA00000612F.f.03.1 | M00004236D:E07 |
| 544 | May 14, 1998 | 1487 | 544 | RTA00000606F.p.14.1 | M00003890B:H07 |
| 545 | May 14, 1998 | 1487 | 545 | RTA00000612F.j.17.2 | M00004260C:E10 |
| 546 | May 14, 1998 | 1487 | 546 | RTA00000585F.c.24.2 | M00001421A:H07 |
| 547 | May 14, 1998 | 1487 | 547 | RTA00000607F.i.24.2 | M00003926B:E03 |
| 548 | May 14, 1998 | 1487 | 548 | RTA00000609F.e.15.3 | M00004058C:E08 |
| 549 | May 14, 1998 | 1487 | 549 | RTA00000584F.p.18.1 | M00001411C:G02 |
| 550 | May 14, 1998 | 1487 | 550 | RTA00000610F.i.10.1 | M00004130C:A09 |
| 551 | May 14, 1998 | 1487 | 551 | RTA00000585F.b.17.3 | M00001417B:C07 |
| 552 | May 14, 1998 | 1487 | 552 | RTA00000586F.o.12.1 | M00001504C:H11 |
| 553 | May 14, 1998 | 1487 | 553 | RTA00000608F.g.24.1 | M00003992C:G01 |
| 554 | May 14, 1998 | 1487 | 554 | RTA00000584F.e.20.1 | M00001387A:A04 |
| 555 | May 14, 1998 | 1487 | 555 | RTA00000588F.j.23.3 | M00003843A:B01 |
| 556 | May 14, 1998 | 1487 | 556 | RTA00000585F.b.21.3 | M00001417C:E02 |
| 557 | May 14, 1998 | 1487 | 557 | RTA00000584F.o.08.1 | M00001408A:B02 |
| 558 | May 14, 1998 | 1487 | 558 | RTA00000587F.k.22.1 | M00001563C:D06 |
| 559 | May 14, 1998 | 1487 | 559 | RTA00000608F.a.07.3 | M00003972C:F02 |
| 560 | May 14, 1998 | 1487 | 560 | RTA00000597F.c.04.4 | M00003773B:E09 |
| 561 | May 14, 1998 | 1487 | 561 | RTA00000596F.c.06.1 | M00001669B:A03 |
| 562 | May 14, 1998 | 1487 | 562 | RTA00000588F.o.01.2 | M00003912C:H01 |
| 563 | May 14, 1998 | 1487 | 563 | RTA00000597F.i.16.1 | M00003797D:H06 |
| 564 | May 14, 1998 | 1487 | 564 | RTA00000583F.n.07.1 | M00001370B:D04 |
| 565 | May 14, 1998 | 1487 | 565 | RTA00000597F.f.07.1 | M00003785D:E01 |
| 566 | May 14, 1998 | 1487 | 566 | RTA00000587F.f.06.1 | M00001543A:E04 |
| 567 | May 14, 1998 | 1487 | 567 | RTA00000614F.o.11.1 | M00004509A:H02 |
| 568 | May 14, 1998 | 1487 | 568 | RTA00000597F.b.16.5 | M00003771D:A10 |
| 569 | May 14, 1998 | 1487 | 569 | RTA00000608F.m.19.1 | M00004035B:H11 |
| 570 | May 14, 1998 | 1487 | 570 | RTA00000597F.k.21.1 | M00003808C:D09 |
| 571 | May 14, 1998 | 1487 | 571 | RTA00000584F.o.13.1 | M00001409C:D01 |
| 572 | May 14, 1998 | 1487 | 572 | RTA00000588F.n.10.3 | M00003895D:A03 |
| 573 | May 14, 1998 | 1487 | 573 | RTA00000589F.h.17.1 | M00004089A:F02 |
| 574 | May 14, 1998 | 1487 | 574 | RTA00000609F.h.13.1 | M00004069D:G02 |
| 575 | May 14, 1998 | 1487 | 575 | RTA00000608F.p.15.1 | M00004043D:C10 |
| 576 | May 14, 1998 | 1487 | 576 | RTA00000595F.l.16.1 | M00001640A:F02 |
| 577 | May 14, 1998 | 1487 | 577 | RTA00000585F.j.21.1 | M00001437B:B05 |
| 578 | May 14, 1998 | 1487 | 578 | RTA00000595F.o.01.2 | M00001649B:E08 |
| 579 | May 14, 1998 | 1487 | 579 | RTA00000606F.c.03.1 | M00003829A:B08 |
| 580 | May 14, 1998 | 1487 | 580 | RTA00000583F.n.04.1 | M00001370A:G09 |
| 581 | May 14, 1998 | 1487 | 581 | RTA00000596F.p.20.1 | M00003766B:G04 |
| 582 | May 14, 1998 | 1487 | 582 | RTA00000611F.c.20.2 | M00004166C:A03 |
| 583 | May 14, 1998 | 1487 | 583 | RTA00000584F.l.19.1 | M00001399D:F09 |
| 584 | May 14, 1998 | 1487 | 584 | RTA00000589F.p.23.1 | M00004239C:A07 |
| 585 | May 14, 1998 | 1487 | 585 | RTA00000607F.c.09.2 | M00003903C:H03 |
| 586 | May 14, 1998 | 1487 | 586 | RTA00000585F.p.23.2 | M00001453D:F09 |
| 587 | May 14, 1998 | 1487 | 587 | RTA00000596F.j.13.1 | M00003741A:E01 |
| 588 | May 14, 1998 | 1487 | 588 | RTA00000584F.m.03.1 | M00001400D:B08 |
| 589 | May 14, 1998 | 1487 | 589 | RTA00000595F.o.03.2 | M00001649D:H05 |
| 590 | May 14, 1998 | 1487 | 590 | RTA00000589F.j.03.1 | M00004109B:A01 |
| 591 | May 14, 1998 | 1487 | 591 | RTA00000610F.c.14.1 | M00004107C:A01 |
| 592 | May 14, 1998 | 1487 | 592 | RTA00000614F.f.02.1 | M00004412B:E03 |
| 593 | May 14, 1998 | 1487 | 593 | RTA00000608F.b.23.1 | M00003977C:A08 |
| 594 | May 14, 1998 | 1487 | 594 | RTA00000597F.i.06.1 | M00003796B:C07 |
| 595 | May 14, 1998 | 1487 | 595 | RTA00000609F.n.20.1 | M00004087C:F05 |
| 596 | May 14, 1998 | 1487 | 596 | RTA00000597F.c.08.2 | M00003773C:G06 |
| 597 | May 14, 1998 | 1487 | 597 | RTA00000612F.c.05.2 | M00004218C:G10 |

TABLE 1A-continued

Priority Appln Information

| SEQ ID NO: | Filed | Dkt No. | SEQ ID NO: | Sequence Name | Clone Name |
|---|---|---|---|---|---|
| 598 | May 14, 1998 | 1487 | 598 | RTA00000589F.o.14.1 | M00004202B:A02 |
| 599 | May 14, 1998 | 1487 | 599 | RTA00000609F.h.15.1 | M00004071A:H03 |
| 600 | May 14, 1998 | 1487 | 600 | RTA00000596F.p.15.1 | M00003765D:E02 |
| 601 | May 14, 1998 | 1487 | 601 | RTA00000597F.k.22.1 | M00003809A:A12 |
| 602 | May 14, 1998 | 1487 | 602 | RTA00000608F.k.09.1 | M00004028C:D01 |
| 603 | May 14, 1998 | 1487 | 603 | RTA00000612F.p.23.2 | M00004287C:B06 |
| 604 | May 14, 1998 | 1487 | 604 | RTA00000610F.n.02.1 | M00004146D:A07 |
| 605 | May 14, 1998 | 1487 | 605 | RTA00000587F.h.19.2 | M00001551D:C12 |
| 606 | May 14, 1998 | 1487 | 606 | RTA00000607F.k.18.1 | M00003934D:F01 |
| 607 | May 14, 1998 | 1487 | 607 | RTA00000588F.m.10.3 | M00003868D:F07 |
| 608 | May 14, 1998 | 1487 | 608 | RTA00000612F.p.21.1 | M00004287B:B12 |
| 609 | May 14, 1998 | 1487 | 609 | RTA00000585F.m.08.1 | M00001443A:E02 |
| 610 | May 14, 1998 | 1487 | 610 | RTA00000612F.d.01.1 | M00004225D:F01 |
| 611 | May 14, 1998 | 1487 | 611 | RTA00000596F.d.20.1 | M00001675C:B03 |
| 612 | May 14, 1998 | 1487 | 612 | RTA00000611F.k.12.2 | M00004190C:G07 |
| 613 | May 14, 1998 | 1487 | 613 | RTA00000612F.j.11.2 | M00004257C:A08 |
| 614 | May 14, 1998 | 1487 | 614 | RTA00000614F.j.16.1 | M00004463C:F11 |
| 615 | May 14, 1998 | 1487 | 615 | RTA00000611F.k.15.3 | M00004190D:G12 |
| 616 | May 14, 1998 | 1487 | 616 | RTA00000612F.j.01.2 | M00004253D:F09 |
| 617 | May 14, 1998 | 1487 | 617 | RTA00000606F.o.23.1 | M00003888B:A10 |
| 618 | May 14, 1998 | 1487 | 618 | RTA00000606F.i.13.1 | M00003852D:D03 |
| 619 | May 14, 1998 | 1487 | 619 | RTA00000588F.i.22.3 | M00003833D:D06 |
| 620 | May 14, 1998 | 1487 | 620 | RTA00000585F.j.03.1 | M00001435D:A06 |
| 621 | May 14, 1998 | 1487 | 621 | RTA00000608F.i.21.1 | M00003998A:G12 |
| 622 | May 14, 1998 | 1487 | 622 | RTA00000584F.o.02.1 | M00001406D:B06 |
| 623 | May 14, 1998 | 1487 | 623 | RTA00000608F.m.17.1 | M00004035B:F05 |
| 624 | May 14, 1998 | 1487 | 624 | RTA00000612F.k.08.2 | M00004263D:F06 |
| 625 | May 14, 1998 | 1487 | 625 | RTA00000608F.p.20.1 | M00004045A:B12 |
| 626 | May 14, 1998 | 1487 | 626 | RTA00000610F.n.07.1 | M00004147A:G03 |
| 627 | May 14, 1998 | 1487 | 627 | RTA00000608F.j.17.1 | M00004027A:B10 |
| 628 | May 14, 1998 | 1487 | 628 | RTA00000596F.n.23.1 | M00003759A:E10 |
| 629 | May 14, 1998 | 1487 | 629 | RTA00000612F.a.17.2 | M00004214A:D03 |
| 630 | May 14, 1998 | 1487 | 630 | RTA00000612F.i.17.2 | M00004253B:A10 |
| 631 | May 14, 1998 | 1487 | 631 | RTA00000585F.p.15.2 | M00001452D:E05 |
| 632 | May 14, 1998 | 1487 | 632 | RTA00000614F.m.15.1 | M00004498B:E01 |
| 633 | May 14, 1998 | 1487 | 633 | RTA00000607F.a.08.3 | M00003892D:D04 |
| 634 | May 14, 1998 | 1487 | 634 | RTA00000606F.p.16.1 | M00003890D:C03 |
| 635 | May 14, 1998 | 1487 | 635 | RTA00000610F.j.12.1 | M00004134A:H04 |
| 636 | May 14, 1998 | 1487 | 636 | RTA00000608F.o.16.1 | M00004040C:G12 |
| 637 | May 14, 1998 | 1487 | 637 | RTA00000588F.o.20.2 | M00003958C:C10 |
| 638 | May 14, 1998 | 1487 | 638 | RTA00000585F.p.06.2 | M00001451B:H11 |
| 639 | May 14, 1998 | 1487 | 639 | RTA00000610F.j.05.1 | M00004133D:A01 |
| 640 | May 14, 1998 | 1487 | 640 | RTA00000606F.e.17.1 | M00003839C:B05 |
| 641 | May 14, 1998 | 1487 | 641 | RTA00000609F.n.05.1 | M00004086A:A03 |
| 642 | May 14, 1998 | 1487 | 642 | RTA00000614F.p.22.1 | M00004609C:C11 |
| 643 | May 14, 1998 | 1487 | 643 | RTA00000585F.h.16.2 | M00001433A:F04 |
| 644 | May 14, 1998 | 1487 | 644 | RTA00000611F.n.02.3 | M00004198D:H04 |
| 645 | May 14, 1998 | 1487 | 645 | RTA00000614F.p.06.1 | M00004605C:A09 |
| 646 | May 14, 1998 | 1487 | 646 | RTA00000584F.l.17.1 | M00001399D:F01 |
| 647 | May 14, 1998 | 1487 | 647 | RTA00000584F.p.17.1 | M00001411C:F02 |
| 648 | May 14, 1998 | 1487 | 648 | RTA00000595F.l.17.1 | M00001640A:F04 |
| 649 | May 14, 1998 | 1487 | 649 | RTA00000583F.h.07.1 | M00001353B:D11 |
| 650 | May 14, 1998 | 1487 | 650 | RTA00000585F.l.19.1 | M00001442A:D08 |
| 651 | May 14, 1998 | 1487 | 651 | RTA00000610F.i.13.1 | M00004130D:E04 |
| 652 | May 14, 1998 | 1487 | 652 | RTA00000608F.n.05.1 | M00004036B:F09 |
| 653 | May 14, 1998 | 1487 | 653 | RTA00000612F.m.19.1 | M00004276C:E12 |
| 654 | May 14, 1998 | 1487 | 654 | RTA00000595F.h.22.1 | M00001621C:A04 |
| 655 | May 14, 1998 | 1487 | 655 | RTA00000608F.j.12.1 | M00003999C:C12 |
| 656 | May 14, 1998 | 1487 | 656 | RTA00000608F.k.07.2 | M00004028C:B04 |
| 657 | May 14, 1998 | 1487 | 657 | RTA00000608F.o.12.1 | M00004040B:B09 |
| 658 | May 14, 1998 | 1487 | 658 | RTA00000597F.a.08.5 | M00003767C:F04 |
| 659 | May 14, 1998 | 1487 | 659 | RTA00000585F.i.23.1 | M00001435C:G08 |
| 660 | May 14, 1998 | 1487 | 660 | RTA00000586F.j.06.1 | M00001487D:G03 |
| 661 | May 14, 1998 | 1487 | 661 | RTA00000608F.b.15.1 | M00003976C:C05 |
| 662 | May 14, 1998 | 1487 | 662 | RTA00000609F.h.06.1 | M00004069B:B01 |
| 663 | May 14, 1998 | 1487 | 663 | RTA00000612F.h.13.3 | M00004248A:G08 |
| 664 | May 14, 1998 | 1487 | 664 | RTA00000611F.j.08.1 | M00004187C:H09 |
| 665 | May 14, 1998 | 1487 | 665 | RTA00000609F.j.18.1 | M00004076A:E02 |
| 666 | May 14, 1998 | 1487 | 666 | RTA00000608F.p.01.1 | M00004041B:F01 |
| 667 | May 14, 1998 | 1487 | 667 | RTA00000584F.m.16.1 | M00001402D:H03 |
| 668 | May 14, 1998 | 1487 | 668 | RTA00000589F.d.04.1 | M00004036C:D01 |
| 669 | May 14, 1998 | 1487 | 669 | RTA00000612F.p.12.2 | M00004285B:E01 |
| 670 | May 14, 1998 | 1487 | 670 | RTA00000589F.e.09.1 | M00004052C:B05 |

TABLE 1A-continued

Priority Appln Information

| SEQ ID NO: | Filed | Dkt No. | SEQ ID NO: | Sequence Name | Clone Name |
|---|---|---|---|---|---|
| 671 | May 14, 1998 | 1487 | 671 | RTA00000584F.m.11.1 | M00001402C:E09 |
| 672 | May 14, 1998 | 1487 | 672 | RTA00000595F.i.18.1 | M00001624A:A09 |
| 673 | May 14, 1998 | 1487 | 673 | RTA00000609F.k.04.2 | M00004078A:F03 |
| 674 | May 14, 1998 | 1487 | 674 | RTA00000611F.n.17.2 | M00004200B:B04 |
| 675 | May 14, 1998 | 1487 | 675 | RTA00000595F.j.03.1 | M00001626B:H05 |
| 676 | May 14, 1998 | 1487 | 676 | RTA00000611F.o.11.3 | M00004202B:F04 |
| 677 | May 14, 1998 | 1487 | 677 | RTA00000597F.e.16.1 | M00003783C:A06 |
| 678 | May 14, 1998 | 1487 | 678 | RTA00000583F.d.16.1 | M00001346A:B09 |
| 679 | May 14, 1998 | 1487 | 679 | RTA00000589F.l.24.1 | M00004159D:C04 |
| 680 | May 14, 1998 | 1487 | 680 | RTA00000597F.a.17.2 | M00003769B:A04 |
| 681 | May 14, 1998 | 1487 | 681 | RTA00000584F.p.22.1 | M00001412A:A11 |
| 682 | May 14, 1998 | 1487 | 682 | RTA00000587F.i.23.1 | M00001557B:D10 |
| 683 | May 14, 1998 | 1487 | 683 | RTA00000612F.l.16.2 | M00004269D:E08 |
| 684 | May 14, 1998 | 1487 | 684 | RTA00000584F.c.01.1 | M00001380C:D10 |
| 685 | May 14, 1998 | 1487 | 685 | RTA00000606F.g.21.1 | M00003846D:C12 |
| 686 | May 14, 1998 | 1487 | 686 | RTA00000611F.j.12.1 | M00004188A:E10 |
| 687 | May 14, 1998 | 1487 | 687 | RTA00000585F.h.10.2 | M00001432C:G01 |
| 688 | May 14, 1998 | 1487 | 688 | RTA00000585F.h.10.1 | M00001432C:G01 |
| 689 | May 14, 1998 | 1487 | 689 | RTA00000587F.j.15.1 | M00001560C:C01 |
| 690 | May 14, 1998 | 1487 | 690 | RTA00000608F.o.06.1 | M00004039D:D03 |
| 691 | May 14, 1998 | 1487 | 691 | RTA00000596F.e.05.2 | M00001677A:A06 |
| 692 | May 14, 1998 | 1487 | 692 | RTA00000584F.p.07.1 | M00001411A:D01 |
| 693 | May 14, 1998 | 1487 | 693 | RTA00000612F.i.13.2 | M00004252D:H08 |
| 694 | May 14, 1998 | 1487 | 694 | RTA00000607F.i.14.4 | M00003923A:H07 |
| 695 | May 14, 1998 | 1487 | 695 | RTA00000595F.m.17.2 | M00001645B:C09 |
| 696 | May 14, 1998 | 1487 | 696 | RTA00000595F.i.02.1 | M00001621D:B09 |
| 697 | May 14, 1998 | 1487 | 697 | RTA00000585F.p.12.2 | M00001452B:F09 |
| 698 | May 14, 1998 | 1487 | 698 | RTA00000589F.m.02.1 | M00004160A:D07 |
| 699 | May 14, 1998 | 1487 | 699 | RTA00000595F.p.11.1 | M00001655A:F07 |
| 700 | May 14, 1998 | 1487 | 700 | RTA00000589F.o.15.1 | M00004202B:G09 |
| 701 | May 14, 1998 | 1487 | 701 | RTA00000609F.e.12.3 | M00004058B:C11 |
| 702 | May 14, 1998 | 1487 | 702 | RTA00000588F.l.13.2 | M00003858A:D01 |
| 703 | May 14, 1998 | 1487 | 703 | RTA00000608F.f.22.2 | M00003988B:C10 |
| 704 | May 14, 1998 | 1487 | 704 | RTA00000612F.i.11.2 | M00004252D:A07 |
| 705 | May 14, 1998 | 1487 | 705 | RTA00000590F.b.13.1 | M00004277D:C08 |
| 706 | May 14, 1998 | 1487 | 706 | RTA00000609F.a.21.2 | M00004047B:G09 |
| 707 | May 14, 1998 | 1487 | 707 | RTA00000586F.e.12.1 | M00001468D:D11 |
| 708 | May 14, 1998 | 1487 | 708 | RTA00000595F.k.10.1 | M00001634C:E12 |
| 709 | May 14, 1998 | 1487 | 709 | RTA00000583F.e.02.1 | M00001346C:B07 |
| 710 | May 14, 1998 | 1487 | 710 | RTA00000589F.d.01.1 | M00004035D:C05 |
| 711 | May 14, 1998 | 1487 | 711 | RTA00000584F.n.14.1 | M00001406A:G12 |
| 712 | May 14, 1998 | 1487 | 712 | RTA00000612F.k.21.2 | M00004266B:H06 |
| 713 | May 14, 1998 | 1487 | 713 | RTA00000612F.m.05.1 | M00004272D:D02 |
| 714 | May 14, 1998 | 1487 | 714 | RTA00000584F.a.20.2 | M00001377C:B08 |
| 715 | May 14, 1998 | 1487 | 715 | RTA00000612F.b.11.2 | M00004217A:A05 |
| 716 | May 14, 1998 | 1487 | 716 | RTA00000610F.h.13.1 | M00004126D:B11 |
| 717 | May 14, 1998 | 1487 | 717 | RTA00000611F.d.04.1 | M00004167C:F10 |
| 718 | May 14, 1998 | 1487 | 718 | RTA00000607F.f.12.2 | M00003914C:E03 |
| 719 | May 14, 1998 | 1487 | 719 | RTA00000586F.j.10.1 | M00001488B:H02 |
| 720 | May 14, 1998 | 1487 | 720 | RTA00000584F.p.20.1 | M00001411D:C01 |
| 721 | May 14, 1998 | 1487 | 721 | RTA00000612F.i.19.2 | M00004253C:E10 |
| 722 | May 14, 1998 | 1487 | 722 | RTA00000608F.i.09.1 | M00003996D:C04 |
| 723 | May 14, 1998 | 1487 | 723 | RTA00000584F.g.09.1 | M00001390A:H01 |
| 724 | May 14, 1998 | 1487 | 724 | RTA00000584F.n.12.1 | M00001405D:F05 |
| 725 | May 14, 1998 | 1487 | 725 | RTA00000584F.j.12.1 | M00001397B:H11 |
| 726 | May 14, 1998 | 1487 | 726 | RTA00000611F.h.21.2 | M00004183D:B07 |
| 727 | May 14, 1998 | 1487 | 727 | RTA00000606F.l.23.1 | M00003871A:E09 |
| 728 | May 14, 1998 | 1487 | 728 | RTA00000585F.b.01.3 | M00001415D:A05 |
| 729 | May 14, 1998 | 1487 | 729 | RTA00000595F.i.13.1 | M00001623B:B01 |
| 730 | May 14, 1998 | 1487 | 730 | RTA00000589F.l.22.1 | M00004158C:F03 |
| 731 | May 14, 1998 | 1487 | 731 | RTA00000608F.l.14.1 | M00004031D:G02 |
| 732 | May 14, 1998 | 1487 | 732 | RTA00000614F.k.18.1 | M00004469A:C12 |
| 733 | May 14, 1998 | 1487 | 733 | RTA00000609F.g.19.1 | M00004068B:D04 |
| 734 | May 14, 1998 | 1487 | 734 | RTA00000606F.g.05.1 | M00003845A:A05 |
| 735 | May 14, 1998 | 1487 | 735 | RTA00000585F.i.03.1 | M00001434A:A01 |
| 736 | May 14, 1998 | 1487 | 736 | RTA00000590F.a.15.1 | M00004247B:C11 |
| 737 | May 14, 1998 | 1487 | 737 | RTA00000612F.j.15.2 | M00004260C:A12 |
| 738 | May 14, 1998 | 1487 | 738 | RTA00000612F.g.13.3 | M00004241B:B01 |
| 739 | May 14, 1998 | 1487 | 739 | RTA00000606F.d.21.1 | M00003835D:H05 |
| 740 | May 14, 1998 | 1487 | 740 | RTA00000584F.b.06.1 | M00001378B:F06 |
| 741 | May 14, 1998 | 1487 | 741 | RTA00000614F.e.17.1 | M00004410A:E03 |
| 742 | May 14, 1998 | 1487 | 742 | RTA00000612F.a.13.2 | M00004213A:H12 |
| 743 | May 14, 1998 | 1487 | 743 | RTA00000585F.o.10.2 | M00001448A:D05 |

TABLE 1A-continued

Priority Appln Information

| SEQ ID NO: | Filed | Dkt No. | SEQ ID NO: | Sequence Name | Clone Name |
|---|---|---|---|---|---|
| 744 | May 14, 1998 | 1487 | 744 | RTA00000588F.i.14.3 | M00003830A:A10 |
| 745 | May 14, 1998 | 1487 | 745 | RTA00000595F.e.10.1 | M00001605D:G01 |
| 746 | May 14, 1998 | 1487 | 746 | RTA00000584F.b.06.2 | M00001378B:F06 |
| 747 | May 14, 1998 | 1487 | 747 | RTA00000608F.j.05.1 | M00003998C:H10 |
| 748 | May 14, 1998 | 1487 | 748 | RTA00000611F.j.24.2 | M00004190A:C12 |
| 749 | May 14, 1998 | 1487 | 749 | RTA00000606F.h.12.1 | M00003850B:D11 |
| 750 | May 14, 1998 | 1487 | 750 | RTA00000608F.c.22.1 | M00003980B:F12 |
| 751 | May 14, 1998 | 1487 | 751 | RTA00000588F.b.03.1 | M00001618B:F02 |
| 752 | May 15, 1998 | 1488 | 1 | RTA00000623F.c.23.1 | M00007118C:G2 |
| 753 | May 15, 1998 | 1488 | 2 | RTA00000592F.e.05.1 | M00005799C:C12 |
| 754 | May 15, 1998 | 1488 | 3 | RTA00000590F.p.04.1 | M00005390B:G10 |
| 755 | May 15, 1998 | 1488 | 4 | RTA00000621F.m.13.1 | M00006986C:G11 |
| 756 | May 15, 1998 | 1488 | 5 | RTA00000625F.n.12.1 | M00006604C:H10 |
| 757 | May 15, 1998 | 1488 | 6 | RTA00000624F.b.01.1 | M00005539D:G7 |
| 758 | May 15, 1998 | 1488 | 7 | RTA00000618F.h.12.1 | M00006698B:E6 |
| 759 | May 15, 1998 | 1488 | 8 | RTA00000615F.h.16.1 | M00005015D:D11 |
| 760 | May 15, 1998 | 1488 | 9 | RTA00000618F.l.23.1 | M00006721C:G7 |
| 761 | May 15, 1998 | 1488 | 10 | RTA00000619F.n.10.3 | M00006820A:G5 |
| 762 | May 15, 1998 | 1488 | 11 | RTA00000621F.o.06.1 | M00006992C:G2 |
| 763 | May 15, 1998 | 1488 | 12 | RTA00000619F.c.17.1 | M00006756D:E10 |
| 764 | May 15, 1998 | 1488 | 13 | RTA00000615F.i.14.1 | M00005294D:H2 |
| 765 | May 15, 1998 | 1488 | 14 | RTA00000617F.k.23.1 | M00005496D:A10 |
| 766 | May 15, 1998 | 1488 | 15 | RTA00000623F.e.05.1 | M00007125D:E3 |
| 767 | May 15, 1998 | 1488 | 16 | RTA00000617F.c.04.1 | M00005456B:B7 |
| 768 | May 15, 1998 | 1488 | 17 | RTA00000623F.a.23.1 | M00007107A:D11 |
| 769 | May 15, 1998 | 1488 | 18 | RTA00000619F.f.15.1 | M00006770B:C5 |
| 770 | May 15, 1998 | 1488 | 19 | RTA00000626F.f.07.1 | M00006650A:A10 |
| 771 | May 15, 1998 | 1488 | 20 | R1A00000624F.h.14.1 | M00005621D:F1 |
| 772 | May 15, 1998 | 1488 | 21 | RTA00000617F.f.09.2 | M00005469D:C11 |
| 773 | May 15, 1998 | 1488 | 22 | RTA00000620F.b.02.1 | M00006835B:F4 |
| 774 | May 15, 1998 | 1488 | 23 | RTA00000616F.k.05.1 | M00005415D:G2 |
| 775 | May 15, 1998 | 1488 | 24 | RTA00000617F.a.01.1 | M00005447B:D2 |
| 776 | May 15, 1998 | 1488 | 25 | RTA00000592F.f.23.1 | M00006587A:H8 |
| 777 | May 15, 1998 | 1488 | 26 | RTA00000623F.h.17.1 | M00007150A:C9 |
| 778 | May 15, 1998 | 1488 | 27 | RTA00000622F.b.02.1 | M00007010B:H1 |
| 779 | May 15, 1998 | 1488 | 28 | RTA00000621F.p.05.1 | M00006995C:A2 |
| 780 | May 15, 1998 | 1488 | 29 | RTA00000620F.j.05.1 | M00006884D:D6 |
| 781 | May 15, 1998 | 1488 | 30 | RTA00000623F.h.20.1 | M00007150A:H6 |
| 782 | May 15, 1998 | 1488 | 31 | RTA00000590F.p.21.1 | M00005399A:D1 |
| 783 | May 15, 1998 | 1488 | 32 | RTA00000622F.c.03.1 | M00007013B:F2 |
| 784 | May 15, 1998 | 1488 | 33 | RTA00000623F.f.06.1 | M00007132B:B11 |
| 785 | May 15, 1998 | 1488 | 34 | RTA00000617F.e.23.2 | M00005468A:D8 |
| 786 | May 15, 1998 | 1488 | 35 | RTA00000623F.n.17.1 | M00007204C:F9 |
| 787 | May 15, 1998 | 1488 | 36 | RTA00000619F.a.12.1 | M00006743B:G12 |
| 788 | May 15, 1998 | 1488 | 37 | RTA00000621F.n.06.1 | M00006989B:C11 |
| 789 | May 15, 1998 | 1488 | 38 | RTA00000623F.a.18.1 | M00007105D:C7 |
| 790 | May 15, 1998 | 1488 | 39 | RTA00000624F.a.15.1 | M00005534B:H10 |
| 791 | May 15, 1998 | 1488 | 40 | RTA00000625F.h.04.1 | M00005810C:D4 |
| 792 | May 15, 1998 | 1488 | 41 | RTA00000591F.g.05.1 | M00005460B:D2 |
| 793 | May 15, 1998 | 1488 | 42 | RTA00000620F.i.14.1 | M00006882A:D1 |
| 794 | May 15, 1998 | 1488 | 43 | RTA00000624F.a.14.1 | M00005534A:G6 |
| 795 | May 15, 1998 | 1488 | 44 | RTA00000621F.h.14.1 | M00006960D:E6 |
| 796 | May 15, 1998 | 1488 | 45 | RTA00000617F.k.19.1 | M00005494D:F11 |
| 797 | May 15, 1998 | 1488 | 46 | RTA00000625F.d.17.1 | M00005763B:H9 |
| 798 | May 15, 1998 | 1488 | 47 | RTA00000620F.l.13.1 | M00006901D:A11 |
| 799 | May 15, 1998 | 1488 | 48 | RTA00000623F.g.04.1 | M00007140A:F11 |
| 800 | May 15, 1998 | 1488 | 49 | RTA00000622F.b.03.1 | M00007010B:H3 |
| 801 | May 15, 1998 | 1488 | 50 | RTA00000615F.k.17.1 | M00005342A:C4 |
| 802 | May 15, 1998 | 1488 | 51 | RTA00000618F.m.11.1 | M00006725A:A3 |
| 803 | May 15, 1998 | 1488 | 52 | RTA00000618F.e.06.1 | M00006686A:G12 |
| 804 | May 15, 1998 | 1488 | 53 | RTA00000619F.k.08.1 | M00006805B:C4 |
| 805 | May 15, 1998 | 1488 | 54 | RTA00000590F.h.23.2 | M00004840C:F2 |
| 806 | May 15, 1998 | 1488 | 55 | RTA00000622F.c.09.1 | M00007014C:B7 |
| 807 | May 15, 1998 | 1488 | 56 | RTA00000619F.h.17.1 | M00006785B:F9 |
| 808 | May 15, 1998 | 1488 | 57 | RTA00000617F.d.01.1 | M00005460A:B10 |
| 809 | May 15, 1998 | 1488 | 58 | RTA00000620F.b.17.1 | M00006837C:G6 |
| 810 | May 15, 1998 | 1488 | 59 | RTA00000616F.c.13.1 | M00005383D:D6 |
| 811 | May 15, 1998 | 1488 | 60 | RTA00000619F.g.16.1 | M00006779B:A11 |
| 812 | May 15, 1998 | 1488 | 61 | RTA00000591F.i.12.1 | M00005480A:H12 |
| 813 | May 15, 1998 | 1488 | 62 | RTA00000615F.b.20.1 | M00004846A:D2 |
| 814 | May 15, 1998 | 1488 | 63 | RTA00000615F.l.18.1 | M00005352C:G9 |
| 815 | May 15, 1998 | 1488 | 64 | RTA00000591F.m.19.1 | M00005519B:H4 |
| 816 | May 15, 1998 | 1488 | 65 | RTA00000620F.i.10.1 | M00006879A:H11 |

TABLE 1A-continued

Priority Appln Information

| SEQ ID NO: | Filed | Dkt No. | SEQ ID NO: | Sequence Name | Clone Name |
|---|---|---|---|---|---|
| 817 | May 15, 1998 | 1488 | 66 | RTA00000618F.o.02.1 | M00006733D:G12 |
| 818 | May 15, 1998 | 1488 | 67 | RTA00000620F.c.18.1 | M00006846A:B1 |
| 819 | May 15, 1998 | 1488 | 68 | RTA00000624F.a.07.1 | M00005530B:D3 |
| 820 | May 15, 1998 | 1488 | 69 | RTA00000592F.c.10.1 | M00005704A:B11 |
| 821 | May 15, 1998 | 1488 | 70 | RTA00000618F.c.04.1 | M00006676B:F11 |
| 822 | May 15, 1998 | 1488 | 71 | RTA00000591F.f.04.1 | M00005452C:A2 |
| 823 | May 15, 1998 | 1488 | 72 | RTA00000617F.k.22.1 | M00005496C:A1 |
| 824 | May 15, 1998 | 1488 | 73 | RTA00000626F.e.02.1 | M00006644A:B11 |
| 825 | May 15, 1998 | 1488 | 74 | RTA00000592F.d.09.1 | M00005765C:C4 |
| 826 | May 15, 1998 | 1488 | 75 | RTA00000615F.n.23.1 | M00005359D:H8 |
| 827 | May 15, 1998 | 1488 | 76 | RTA00000591F.i.15.1 | M00005480C:B12 |
| 828 | May 15, 1998 | 1488 | 77 | RTA00000624F.a.11.1 | M00005531B:A3 |
| 829 | May 15, 1998 | 1488 | 78 | RTA00000590F.i.01.1 | M00004841C:B9 |
| 830 | May 15, 1998 | 1488 | 79 | RTA00000626F.d.05.1 | M00006640A:B1 |
| 831 | May 15, 1998 | 1488 | 80 | RTA00000591F.e.19.1 | M00005450A:B10 |
| 832 | May 15, 1998 | 1488 | 81 | RTA00000625F.m.06.1 | M00006594A:E8 |
| 833 | May 15, 1998 | 1488 | 82 | RTA00000615F.k.22.1 | M00005342B:G10 |
| 834 | May 15, 1998 | 1488 | 83 | RTA00000615F.m.11.1 | M00005354C:E2 |
| 835 | May 15, 1998 | 1488 | 84 | RTA00000624F.j.16.1 | M00005631A:A11 |
| 836 | May 15, 1998 | 1488 | 85 | RTA00000626F.d.07.1 | M00006640B:F5 |
| 837 | May 15, 1998 | 1488 | 86 | RTA00000620F.p.19.1 | M00006923C:B1 |
| 838 | May 15, 1998 | 1488 | 87 | RTA00000615F.f.10.1 | M00004999A:F1 |
| 839 | May 15, 1998 | 1488 | 88 | RTA00000615F.b.19.1 | M00004845D:E11 |
| 840 | May 15, 1998 | 1488 | 89 | RTA00000626F.a.07.1 | M00006626A:G11 |
| 841 | May 15, 1998 | 1488 | 90 | RTA00000592F.b.20.1 | M00005685B:D8 |
| 842 | May 15, 1998 | 1488 | 91 | RTA00000622F.p.16.1 | M00007100C:D1 |
| 843 | May 15, 1998 | 1488 | 92 | RTA00000620F.a.16.1 | M00006834A:C8 |
| 844 | May 15, 1998 | 1488 | 93 | RTA00000623F.e.21.1 | M00007130B:B3 |
| 845 | May 15, 1998 | 1488 | 94 | RTA00000619F.k.05.1 | M00006805A:E11 |
| 846 | May 15, 1998 | 1488 | 95 | RTA00000626F.c.10.1 | M00006636D:A5 |
| 847 | May 15, 1998 | 1488 | 96 | RTA00000619F.i.13.1 | M00006791B:B8 |
| 848 | May 15, 1998 | 1488 | 97 | RTA00000620F.k.22.1 | M00006895D:E10 |
| 849 | May 15, 1998 | 1488 | 98 | RTA00000617F.a.17.1 | M00005450D:D2 |
| 850 | May 15, 1998 | 1488 | 99 | RTA00000617F.c.18.1 | M00005457D:C8 |
| 851 | May 15, 1998 | 1488 | 100 | RTA00000626F.g.12.1 | M00006664B:B4 |
| 852 | May 15, 1998 | 1488 | 101 | RTA00000617F.j.11.1 | M00005489A:F6 |
| 853 | May 15, 1998 | 1488 | 102 | RTA00000621F.c.11.1 | M00006936B:E9 |
| 854 | May 15, 1998 | 1488 | 103 | RTA00000623F.f.12.1 | M00007134B:G7 |
| 855 | May 15, 1998 | 1488 | 104 | RTA00000626F.g.17.1 | M00006665A:F7 |
| 856 | May 15, 1998 | 1488 | 105 | RTA00000619F.o.06.4 | M00006823D:D12 |
| 857 | May 15, 1998 | 1488 | 106 | RTA00000625F.j.10.1 | M00005837A:D12 |
| 858 | May 15, 1998 | 1488 | 107 | RTA00000620F.k.12.1 | M00006893C:F2 |
| 859 | May 15, 1998 | 1488 | 108 | RTA00000625F.j.06.1 | M00005828D:C9 |
| 860 | May 15, 1998 | 1488 | 109 | RTA00000616F.b.12.1 | M00005378A:A8 |
| 861 | May 15, 1998 | 1488 | 110 | RTA00000620F.d.04.1 | M00006850C:G7 |
| 862 | May 15, 1998 | 1488 | 111 | RTA00000624F.n.20.1 | M00005655D:C4 |
| 863 | May 15, 1998 | 1488 | 112 | RTA00000620F.m.14.1 | M00006907C:D3 |
| 864 | May 15, 1998 | 1488 | 113 | RTA00000625F.m.15.1 | M00006596D:H4 |
| 865 | May 15, 1998 | 1488 | 114 | RTA00000619F.g.19.1 | M00006779D:D3 |
| 866 | May 15, 1998 | 1488 | 115 | RTA00000626F.b.10.1 | M00006633D:A6 |
| 867 | May 15, 1998 | 1488 | 116 | RTA00000618F.c.23.1 | M00006679C:D7 |
| 868 | May 15, 1998 | 1488 | 117 | RTA00000591F.o.17.1 | M00005616B:D5 |
| 869 | May 15, 1998 | 1488 | 118 | RTA00000615F.b.23.1 | M00004846D:H9 |
| 870 | May 15, 1998 | 1488 | 119 | RTA00000616F.e.20.1 | M00005394A:G7 |
| 871 | May 15, 1998 | 1488 | 120 | RTA00000625F.b.23.1 | M00005720B:D9 |
| 872 | May 15, 1998 | 1488 | 121 | RTA00000616F.i.13.4 | M00005409D:C2 |
| 873 | May 15, 1998 | 1488 | 122 | RTA00000624F.l.02.1 | M00005637D:C5 |
| 874 | May 15, 1998 | 1488 | 123 | RTA00000619F.b.06.1 | M00006745D:E8 |
| 875 | May 15, 1998 | 1488 | 124 | RTA00000626F.b.23.1 | M00006636A:E6 |
| 876 | May 15, 1998 | 1488 | 125 | RTA00000615F.k.24.1 | M00005342D:F3 |
| 877 | May 15, 1998 | 1488 | 126 | RTA00000621F.h.22.1 | M00006963A:H11 |
| 878 | May 15, 1998 | 1488 | 127 | RTA00000626F.b.05.1 | M00006631D:C4 |
| 879 | May 15, 1998 | 1488 | 128 | RTA00000621F.i.20.2 | M00006966D:G3 |
| 880 | May 15, 1998 | 1488 | 129 | RTA00000624F.m.10.1 | M00005646D:B3 |
| 881 | May 15, 1998 | 1488 | 130 | RTA00000623F.m.19.1 | M00007198C:A10 |
| 882 | May 15, 1998 | 1488 | 131 | RTA00000622F.c.12.1 | M00007014D:D4 |
| 883 | May 15, 1998 | 1488 | 132 | RTA00000617F.i.08.1 | M00005483D:A2 |
| 884 | May 15, 1998 | 1488 | 133 | RTA00000625F.b.07.1 | M00005710A:C8 |
| 885 | May 15, 1998 | 1488 | 134 | RTA00000620F.f.23.1 | M00006867C:E7 |
| 886 | May 15, 1998 | 1488 | 135 | RTA00000620F.f.15.1 | M00006866C:F3 |
| 887 | May 15, 1998 | 1488 | 136 | RTA00000621F.k.17.1 | M00006974B:D6 |
| 888 | May 15, 1998 | 1488 | 137 | RTA00000625F.h.18.1 | M00005813D:F6 |
| 889 | May 15, 1998 | 1488 | 138 | RTA00000622F.p.17.1 | M00007101A:A11 |

TABLE 1A-continued

Priority Appln Information

| SEQ ID NO: | Filed | Dkt No. | SEQ ID NO: | Sequence Name | Clone Name |
|---|---|---|---|---|---|
| 890 | May 15, 1998 | 1488 | 139 | RTA00000620F.d.08.1 | M00006851C:H9 |
| 891 | May 15, 1998 | 1488 | 140 | RTA00000621F.i.14.2 | M00006966B:B9 |
| 892 | May 15, 1998 | 1488 | 141 | RTA00000625F.j.19.1 | M00006576D:F11 |
| 893 | May 15, 1998 | 1488 | 142 | RTA00000618F.o.23.1 | M00006737C:A8 |
| 894 | May 15, 1998 | 1488 | 143 | RTA00000618F.m.12.1 | M00006725A:B3 |
| 895 | May 15, 1998 | 1488 | 144 | RTA00000625F.o.19.1 | M00006616D:C8 |
| 896 | May 15, 1998 | 1488 | 145 | RTA00000619F.a.18.1 | M00006744C:C6 |
| 897 | May 15, 1998 | 1488 | 146 | RTA00000624F.c.15.1 | M00005565C:A8 |
| 898 | May 15, 1998 | 1488 | 147 | RTA00000617F.e.13.2 | M00005465C:H2 |
| 899 | May 15, 1998 | 1488 | 148 | RTA00000592F.j.06.1 | M00006664D:H9 |
| 900 | May 15, 1998 | 1488 | 149 | RTA00000615F.n.18.1 | M00005359B:G1 |
| 901 | May 15, 1998 | 1488 | 150 | RTA00000624F.c.02.1 | M00005550B:D9 |
| 902 | May 15, 1998 | 1488 | 151 | RTA00000620F.j.10.1 | M00006886A:D6 |
| 903 | May 15, 1998 | 1488 | 152 | RTA00000620F.e.07.1 | M00006860B:H1 |
| 904 | May 15, 1998 | 1488 | 153 | RTA00000625F.g.07.1 | M00005798B:C11 |
| 905 | May 15, 1998 | 1488 | 154 | RTA00000617F.d.22.1 | M00005462C:B2 |
| 906 | May 15, 1998 | 1488 | 155 | RTA00000622F.a.12.1 | M00007006D:D4 |
| 907 | May 15, 1998 | 1488 | 156 | RTA00000620F.i.11.1 | M00006879D:A10 |
| 908 | May 15, 1998 | 1488 | 157 | RTA00000616F.k.03.1 | M00005415C:G8 |
| 909 | May 15, 1998 | 1488 | 158 | RTA00000624F.k.17.1 | M00005636C:D11 |
| 910 | May 15, 1998 | 1488 | 159 | RTA00000615F.f.11.1 | M00004999B:D12 |
| 911 | May 15, 1998 | 1488 | 160 | RTA00000620F.o.07.1 | M00006917C:E7 |
| 912 | May 15, 1998 | 1488 | 161 | RTA00000617F.k.11.1 | M00005493B:C8 |
| 913 | May 15, 1998 | 1488 | 162 | RTA00000622F.g.04.1 | M00007037B:D4 |
| 914 | May 15, 1998 | 1488 | 163 | RTA00000591F.n.04.1 | M00005528D:H6 |
| 915 | May 15, 1998 | 1488 | 164 | RTA00000625F.a.16.1 | M00005706D:A9 |
| 916 | May 15, 1998 | 1488 | 165 | RTA00000620F.m.18.1 | M00006908C:AS |
| 917 | May 15, 1998 | 1488 | 166 | RTA00000620F.a.04.1 | M00006832D:F10 |
| 918 | May 15, 1998 | 1488 | 167 | RTA00000624F.j.20.1 | M00005632C:D6 |
| 919 | May 15, 1998 | 1488 | 168 | RTA00000590F.n.19.1 | M00005378C:A10 |
| 920 | May 15, 1998 | 1488 | 169 | RTA00000626F.c.13.1 | M00006636D:F11 |
| 921 | May 15, 1998 | 1488 | 170 | RTA00000617F.f.01.2 | M00005468B:D4 |
| 922 | May 15, 1998 | 1488 | 171 | RTA00000621F.i.18.2 | M00006966C:B7 |
| 923 | May 15, 1998 | 1488 | 172 | RTA00000617F.a.13.1 | M00005450A:A2 |
| 924 | May 15, 1998 | 1488 | 173 | RTA00000591F.m.06.1 | M00005513A:D8 |
| 925 | May 15, 1998 | 1488 | 174 | RTA00000615F.g.07.1 | M00005004B:C11 |
| 926 | May 15, 1998 | 1488 | 175 | RTA00000616F.o.24.1 | M00005442D:C5 |
| 927 | May 15, 1998 | 1488 | 176 | RTA00000617F.a.20.1 | M00005451A:E3 |
| 928 | May 15, 1998 | 1488 | 177 | RTA00000626F.a.18.1 | M00006629D:D4 |
| 929 | May 15, 1998 | 1488 | 178 | RTA00000616F.c.23.1 | M00005385C:D8 |
| 930 | May 15, 1998 | 1488 | 179 | RTA00000623F.m.07.1 | M00007193D:A4 |
| 931 | May 15, 1998 | 1488 | 180 | RTA00000620F.h.18.1 | M00006875D:D10 |
| 932 | May 15, 1998 | 1488 | 181 | RTA00000615F.l.16.1 | M00005352B:D2 |
| 933 | May 15, 1998 | 1488 | 182 | RTA00000592F.c.17.1 | M00005708D:B3 |
| 934 | May 15, 1998 | 1488 | 183 | RTA00000616F.c.24.1 | M00005385C:G5 |
| 935 | May 15, 1998 | 1488 | 184 | RTA00000619F.l.16.1 | M00006813A:C4 |
| 936 | May 15, 1998 | 1488 | 185 | RTA00000622F.c.18.1 | M00007015C:G5 |
| 937 | May 15, 1998 | 1488 | 186 | RTA00000620F.p.09.1 | M00006921B:E3 |
| 938 | May 15, 1998 | 1488 | 187 | RTA00000626F.f.08.1 | M00006650A:B11 |
| 939 | May 15, 1998 | 1488 | 188 | RTA00000621F.h.08.1 | M00006960A:G11 |
| 940 | May 15, 1998 | 1488 | 189 | RTA00000591F.g.19.1 | M00005466A:F12 |
| 941 | May 15, 1998 | 1488 | 190 | RTA00000623F.m.10.1 | M00007195B:B2 |
| 942 | May 15, 1998 | 1488 | 191 | RTA00000619F.j.13.1 | M00006796A:H10 |
| 943 | May 15, 1998 | 1488 | 192 | RTA00000619F.f.22.1 | M00006771A:H7 |
| 944 | May 15, 1998 | 1488 | 193 | RTA00000622F.m.06.1 | M00007075C:D8 |
| 945 | May 15, 1998 | 1488 | 194 | RTA00000623F.i.03.1 | M00007154A:E4 |
| 946 | May 15, 1998 | 1488 | 195 | RTA00000625F.k.08.1 | M00006581D:H8 |
| 947 | May 15, 1998 | 1488 | 196 | RTA00000615F.c.13.1 | M00004854A:C9 |
| 948 | May 15, 1998 | 1488 | 197 | RTA00000619F.j.11.1 | M00006796A:C3 |
| 949 | May 15, 1998 | 1488 | 198 | RTA00000619F.o.01.1 | M00006822D:F7 |
| 950 | May 15, 1998 | 1488 | 199 | RTA00000590F.h.12.2 | M00004826A:E9 |
| 951 | May 15, 1998 | 1488 | 200 | RTA00000623F.d.07.1 | M00007121C:H1 |
| 952 | May 15, 1998 | 1488 | 201 | RTA00000616F.f.24.1 | M00005397C:B3 |
| 953 | May 15, 1998 | 1488 | 202 | RTA00000625F.o.03.1 | M00006609A:G10 |
| 954 | May 15, 1998 | 1488 | 203 | RTA00000619F.k.20.1 | M00006807D:D8 |
| 955 | May 15, 1998 | 1488 | 204 | RTA00000625F.n.22.1 | M00006607B:F4 |
| 956 | May 15, 1998 | 1488 | 205 | RTA00000625F.n.03.1 | M00006601D:F4 |
| 957 | May 15, 1998 | 1488 | 206 | RTA00000619F.c.13.1 | M00006756B:B8 |
| 958 | May 15, 1998 | 1488 | 207 | RTA00000625F.g.21.1 | M00005805D:E6 |
| 959 | May 15, 1998 | 1488 | 208 | RTA00000620F.g.06.1 | M00006868D:E2 |
| 960 | May 15, 1998 | 1488 | 209 | RTA00000622F.l.04.1 | M00007065B:B12 |
| 961 | May 15, 1998 | 1488 | 210 | RTA00000624F.d.21.1 | M00005587B:H2 |
| 962 | May 15, 1998 | 1488 | 211 | RTA00000622F.f.20.1 | M00007036A:D2 |

TABLE 1A-continued

Priority Appln Information

| SEQ ID NO: | Filed | Dkt No. | SEQ ID NO: | Sequence Name | Clone Name |
|---|---|---|---|---|---|
| 963 | May 15, 1998 | 1488 | 212 | RTA00000616F.d.09.1 | M00005388A:F7 |
| 964 | May 15, 1998 | 1488 | 213 | RTA00000620F.n.05.1 | M00006912B:E1 |
| 965 | May 15, 1998 | 1488 | 214 | RTA00000624F.k.22.1 | M00005637B:D12 |
| 966 | May 15, 1998 | 1488 | 215 | RTA00000618F.p.11.1 | M00006739B:B12 |
| 967 | May 15, 1998 | 1488 | 216 | RTA00000615F.g.09.1 | M00005005C:E6 |
| 968 | May 15, 1998 | 1488 | 217 | RTA00000618F.j.23.1 | M00006712B:H10 |
| 969 | May 15, 1998 | 1488 | 218 | RTA00000617F.l.02.1 | M00005497B:H7 |
| 970 | May 15, 1998 | 1488 | 219 | RTA00000617F.l.09.1 | M00005498B:F8 |
| 971 | May 15, 1998 | 1488 | 220 | RTA00000625F.n.21.1 | M00006607B:E3 |
| 972 | May 15, 1998 | 1488 | 221 | RTA00000623F.c.20.1 | M00007118B:B4 |
| 973 | May 15, 1998 | 1488 | 222 | RTA00000603F.d.13.1 | M00007019A:B1 |
| 974 | May 15, 1998 | 1488 | 223 | RTA00000625F.k.06.1 | M00006581C:D2 |
| 975 | May 15, 1998 | 1488 | 224 | RTA00000624F.b.23.1 | M00005548B:E3 |
| 976 | May 15, 1998 | 1488 | 225 | RTA00000626F.d.11.1 | M00006640D:H8 |
| 977 | May 15, 1998 | 1488 | 226 | RTA00000620F.g.14.1 | M00006870C:H6 |
| 978 | May 15, 1998 | 1488 | 227 | RTA00000621F.l.17.1 | M00006980A:F2 |
| 979 | May 15, 1998 | 1488 | 228 | RTA00000624F.o.13.1 | M00005685A:A4 |
| 980 | May 15, 1998 | 1488 | 229 | RTA00000621F.k.18.1 | M00006974B:F6 |
| 981 | May 15, 1998 | 1488 | 230 | RTA00000591F.a.23.1 | M00005411D:A3 |
| 982 | May 15, 1998 | 1488 | 231 | RTA00000592F.i.01.1 | M00006641C:H2 |
| 983 | May 15, 1998 | 1488 | 232 | RTA00000625F.p.10.1 | M00006619B:C11 |
| 984 | May 15, 1998 | 1488 | 233 | RTA00000622F.h.04.1 | M00007041B:C5 |
| 985 | May 15, 1998 | 1488 | 234 | RTA00000591F.e.08.1 | M00005446A:G1 |
| 986 | May 15, 1998 | 1488 | 235 | RTA00000619F.d.13.1 | M00006758D:C4 |
| 987 | May 15, 1998 | 1488 | 236 | RTA00000622F.p.10.1 | M00007099A:F9 |
| 988 | May 15, 1998 | 1488 | 237 | RTA00000623F.m.04.1 | M00007192C:H8 |
| 989 | May 15, 1998 | 1488 | 238 | RTA00000617F.i.06.1 | M00005483A:F5 |
| 990 | May 15, 1998 | 1488 | 239 | RTA00000624F.d.24.1 | M00005589C:B3 |
| 991 | May 15, 1998 | 1488 | 240 | RTA00000616F.p.08.1 | M00005444B:E11 |
| 992 | May 15, 1998 | 1488 | 241 | RTA00000615F.j.18.1 | M00005326B:F3 |
| 993 | May 15, 1998 | 1488 | 242 | RTA00000625F.p.19.1 | M00006621A:G10 |
| 994 | May 15, 1998 | 1488 | 243 | RTA00000624F.h.09.1 | M00005620C:C5 |
| 995 | May 15, 1998 | 1488 | 244 | RTA00000619F.d.23.1 | M00006760D:G12 |
| 996 | May 15, 1998 | 1488 | 245 | RTA00000618F.f.24.1 | M00006692B:E4 |
| 997 | May 15, 1998 | 1488 | 246 | RTA00000617F.l.12.1 | M00005498C:G5 |
| 998 | May 15, 1998 | 1488 | 247 | RTA00000621F.o.09.1 | M00006993B:B9 |
| 999 | May 15, 1998 | 1488 | 248 | RTA00000616F.p.04.1 | M00005443D:C12 |
| 1000 | May 15, 1998 | 1488 | 249 | RTA00000620F.c.08.1 | M00006841D:A8 |
| 1001 | May 15, 1998 | 1488 | 250 | RTA00000625F.n.01.1 | M00006601C:A7 |
| 1002 | May 15, 1998 | 1488 | 251 | RTA00000617F.k.10.1 | M00005493B:A12 |
| 1003 | May 15, 1998 | 1488 | 252 | RTA00000624F.l.11.1 | M00005641B:E2 |
| 1004 | May 15, 1998 | 1488 | 253 | RTA00000624F.h.06.1 | M00005619C:H10 |
| 1005 | May 15, 1998 | 1488 | 254 | RTA00000624F.h.11.1 | M00005621A:G10 |
| 1006 | May 15, 1998 | 1488 | 255 | RTA00000590F.h.07.2 | M00004824C:G9 |
| 1007 | May 15, 1998 | 1488 | 256 | RTA00000590F.o.09.1 | M00005384A:A1 |
| 1008 | May 15, 1998 | 1488 | 257 | RTA00000620F.e.16.1 | M00006863B:E6 |
| 1009 | May 15, 1998 | 1488 | 258 | RTA00000620F.k.11.1 | M00006893C:B2 |
| 1010 | May 15, 1998 | 1488 | 259 | RTA00000619F.o.18.4 | M00006825C:D6 |
| 1011 | May 15, 1998 | 1488 | 260 | RTA00000621F.k.03.1 | M00006972A:F10 |
| 1012 | May 15, 1998 | 1488 | 261 | RTA00000625F.c.11.1 | M00005722D:G3 |
| 1013 | May 15, 1998 | 1488 | 262 | RTA00000618F.n.05.1 | M00006727B:G8 |
| 1014 | May 15, 1998 | 1488 | 263 | RTA00000623F.d.02.1 | M00007119B:H10 |
| 1015 | May 15, 1998 | 1488 | 264 | RTA00000615F.k.05.1 | M00005330C:F9 |
| 1016 | May 15, 1998 | 1488 | 265 | RTA00000623F.f.09.1 | M00007132D:G8 |
| 1017 | May 15, 1998 | 1488 | 266 | RTA00000622F.d.01.1 | M00007016C:E6 |
| 1018 | May 15, 1998 | 1488 | 267 | RTA00000618F.p.10.1 | M00006739B:B10 |
| 1019 | May 15, 1998 | 1488 | 268 | RTA00000624F.l.23.1 | M00005645D:F8 |
| 1020 | May 15, 1998 | 1488 | 269 | RTA00000619F.e.19.1 | M00006764B:D5 |
| 1021 | May 15, 1998 | 1488 | 270 | RTA00000622F.h.12.1 | M00007043A:B5 |
| 1022 | May 15, 1998 | 1488 | 271 | RTA00000622F.i.23.1 | M00007051D:D9 |
| 1023 | May 15, 1998 | 1488 | 272 | RTA00000624F.l.13.1 | M00005642B:C3 |
| 1024 | May 15, 1998 | 1488 | 273 | RTA00000624F.a.04.1 | M00005528D:A10 |
| 1025 | May 15, 1998 | 1488 | 274 | RTA00000622F.e.17.1 | M00007031C:D1 |
| 1026 | May 15, 1998 | 1488 | 275 | RTA00000590F.l.12.1 | M00005353B:B9 |
| 1027 | May 15, 1998 | 1488 | 276 | RTA00000626F.f.01.1 | M00006648C:E4 |
| 1028 | May 15, 1998 | 1488 | 277 | RTA00000620F.a.05.1 | M00006832D:F11 |
| 1029 | May 15, 1998 | 1488 | 278 | RTA00000623F.d.04.1 | M00007121A:A5 |
| 1030 | May 15, 1998 | 1488 | 279 | RTA00000618F.p.15.1 | M00006739C:H7 |
| 1031 | May 15, 1998 | 1488 | 280 | RTA00000618F.o.03.1 | M00006734A:H12 |
| 1032 | May 15, 1998 | 1488 | 281 | RTA00000640F.b.02.1 | M00006927C:F12 |
| 1033 | May 15, 1998 | 1488 | 282 | RTA00000619F.g.20.1 | M00006780A:H12 |
| 1034 | May 15, 1998 | 1488 | 283 | RTA00000618F.n.09.1 | M00006728C:B6 |
| 1035 | May 15, 1998 | 1488 | 284 | RTA00000621F.d.09.1 | M00006939B:E5 |

TABLE 1A-continued

Priority Appln Information

| SEQ ID NO: | Filed | Dkt No. | SEQ ID NO: | Sequence Name | Clone Name |
|---|---|---|---|---|---|
| 1036 | May 15, 1998 | 1488 | 285 | RTA00000619F.n.23.4 | M00006822D:D5 |
| 1037 | May 15, 1998 | 1488 | 286 | RTA00000616F.k.16.1 | M00005417A:E10 |
| 1038 | May 15, 1998 | 1488 | 287 | RTA00000625F.f.21.1 | M00005783A:C5 |
| 1039 | May 15, 1998 | 1488 | 288 | RTA00000619F.b.17.1 | M00006751B:B11 |
| 1040 | May 15, 1998 | 1488 | 289 | RTA00000622F.h.11.1 | M00007042A:E7 |
| 1041 | May 15, 1998 | 1488 | 290 | RTA00000621F.k.12.1 | M00006973D:E11 |
| 1042 | May 15, 1998 | 1488 | 291 | RTA00000620F.p.08.1 | M00006921B:E1 |
| 1043 | May 15, 1998 | 1488 | 292 | RTA00000625F.d.13.1 | M00005762D:A1 |
| 1044 | May 15, 1998 | 1488 | 293 | RTA00000592F.g.18.1 | M00006618C:G8 |
| 1045 | May 15, 1998 | 1488 | 294 | RTA00000622F.b.17.1 | M00007012B:D7 |
| 1046 | May 15, 1998 | 1488 | 295 | RTA00000624F.i.07.1 | M00005625D:C3 |
| 1047 | May 15, 1998 | 1488 | 296 | RTA00000619F.c.01.1 | M00006754B:D5 |
| 1048 | May 15, 1998 | 1488 | 297 | RTA00000621F.a.07.1 | M00006926A:H11 |
| 1049 | May 15, 1998 | 1488 | 298 | RTA00000620F.d.21.1 | M00006855C:H2 |
| 1050 | May 15, 1998 | 1488 | 299 | RTA00000616F.c.15.1 | M00005383D:E7 |
| 1051 | May 15, 1998 | 1488 | 300 | RTA00000619F.n.19.4 | M00006822A:D7 |
| 1052 | May 15, 1998 | 1488 | 301 | RTA00000615F.l.09.1 | M00005349B:G1 |
| 1053 | May 15, 1998 | 1488 | 302 | RTA00000626F.b.04.1 | M00006631D:B2 |
| 1054 | May 15, 1998 | 1488 | 303 | RTA00000617F.j.23.1 | M00005491B:C3 |
| 1055 | May 15, 1998 | 1488 | 304 | RTA00000615F.k.14.1 | M00005333C:C8 |
| 1056 | May 15, 1998 | 1488 | 305 | RTA00000616F.l.07.1 | M00005419A:D5 |
| 1057 | May 15, 1998 | 1488 | 306 | RTA00000619F.d.04.1 | M00006758A:B12 |
| 1058 | May 15, 1998 | 1488 | 307 | RTA00000622F.o.15.1 | M00007093A:F9 |
| 1059 | May 15, 1998 | 1488 | 308 | RTA00000625F.m.11.1 | M00006594D:F9 |
| 1060 | May 15, 1998 | 1488 | 309 | RTA00000619F.e.10.1 | M00006763B:B11 |
| 1061 | May 15, 1998 | 1488 | 310 | RTA00000617F.n.15.1 | M00005508B:B4 |
| 1062 | May 15, 1998 | 1488 | 311 | RTA00000615F.n.22.1 | M00005359D:G7 |
| 1063 | May 15, 1998 | 1488 | 312 | RTA00000622F.j.21.1 | M00007058A:C2 |
| 1064 | May 15, 1998 | 1488 | 313 | RTA00000625F.c.09.1 | M00005722A:E9 |
| 1065 | May 15, 1998 | 1488 | 314 | RTA00000591F.m.01.1 | M00005510B:D6 |
| 1066 | May 15, 1998 | 1488 | 315 | RTA00000617F.n.14.1 | M00005508A:H1 |
| 1067 | May 15, 1998 | 1488 | 316 | RTA00000624F.p.18.1 | M00005703A:C8 |
| 1068 | May 15, 1998 | 1488 | 317 | RTA00000623F.j.10.2 | M00007163B:A12 |
| 1069 | May 15, 1998 | 1488 | 318 | RTA00000591F.e.20.1 | M00005450B:B1 |
| 1070 | May 15, 1998 | 1488 | 319 | RTA00000615F.i.11.1 | M00005294C:G8 |
| 1071 | May 15, 1998 | 1488 | 320 | RTA00000622F.p.12.1 | M00007099C:F9 |
| 1072 | May 15, 1998 | 1488 | 321 | RTA00000619F.j.22.1 | M00006800C:G8 |
| 1073 | May 15, 1998 | 1488 | 322 | RTA00000621F.g.12.1 | M00006953D:H11 |
| 1074 | May 15, 1998 | 1488 | 323 | RTA00000617F.m.14.1 | M00005505A:C8 |
| 1075 | May 15, 1998 | 1488 | 324 | RTA00000619F.k.06.1 | M00006805A:H9 |
| 1076 | May 15, 1998 | 1488 | 325 | RTA00000616F.k.18.1 | M00005417C:E10 |
| 1077 | May 15, 1998 | 1488 | 326 | RTA00000625F.d.04.1 | M00005743B:F2 |
| 1078 | May 15, 1998 | 1488 | 327 | RTA00000626F.b.06.1 | M00006631D:E9 |
| 1079 | May 15, 1998 | 1488 | 328 | RTA00000621F.p.15.1 | M00006997B:E6 |
| 1080 | May 15, 1998 | 1488 | 329 | RTA00000618F.d.19.1 | M00006681C:G4 |
| 1081 | May 15, 1998 | 1488 | 330 | RTA00000618F.a.02.1 | M00006665B:D10 |
| 1082 | May 15, 1998 | 1488 | 331 | RTA00000592F.f.15.1 | M00006577B:H12 |
| 1083 | May 15, 1998 | 1488 | 332 | RTA00000619F.d.12.1 | M00006758D:C1 |
| 1084 | May 15, 1998 | 1488 | 333 | RTA00000624F.d.08.1 | M00005571A:E11 |
| 1085 | May 15, 1998 | 1488 | 334 | RTA00000620F.o.15.1 | M00006919B:C3 |
| 1086 | May 15, 1998 | 1488 | 335 | RTA00000620F.e.03.1 | M00006859A:F6 |
| 1087 | May 15, 1998 | 1488 | 336 | RTA00000622F.a.24.1 | M00007010B:C11 |
| 1088 | May 15, 1998 | 1488 | 337 | RTA00000619F.n.04.2 | M00006819A:D10 |
| 1089 | May 15, 1998 | 1488 | 338 | RTA00000616F.d.16.1 | M00005388D:F9 |
| 1090 | May 15, 1998 | 1488 | 339 | RTA00000622F.n.15.1 | M00007085A:B7 |
| 1091 | May 15, 1998 | 1488 | 340 | RTA00000619F.i.04.1 | M00006789C:F4 |
| 1092 | May 15, 1998 | 1488 | 341 | RTA00000617F.i.13.1 | M00005484A:D9 |
| 1093 | May 15, 1998 | 1488 | 342 | RTA00000616F.l.11.1 | M00005419C:D9 |
| 1094 | May 15, 1998 | 1488 | 343 | RTA00000617F.b.18.1 | M00005454C:H12 |
| 1095 | May 15, 1998 | 1488 | 344 | RTA00000618F.j.01.1 | M00006705B:D2 |
| 1096 | May 15, 1998 | 1488 | 345 | RTA00000618F.k.24.1 | M00006717A:D4 |
| 1097 | May 15, 1998 | 1488 | 346 | RTA00000618F.c.05.1 | M00006676D:D11 |
| 1098 | May 15, 1998 | 1488 | 347 | RTA00000619F.g.08.1 | M00006777B:D10 |
| 1099 | May 15, 1998 | 1488 | 348 | RTA00000618F.n.04.1 | M00006727B:E9 |
| 1100 | May 15, 1998 | 1488 | 349 | RTA00000617F.i.09.1 | M00005483D:A12 |
| 1101 | May 15, 1998 | 1488 | 350 | RTA00000617F.l.04.1 | M00005497C:C7 |
| 1102 | May 15, 1998 | 1488 | 351 | RTA00000619F.n.17.4 | M00006821C:C10 |
| 1103 | May 15, 1998 | 1488 | 352 | RTA00000622F.l.09.1 | M00007065D:C1 |
| 1104 | May 15, 1998 | 1488 | 353 | RTA00000623F.j.03.2 | M00007161A:H3 |
| 1105 | May 15, 1998 | 1488 | 354 | RTA00000615F.m.17.1 | M00005356A:D9 |
| 1106 | May 15, 1998 | 1488 | 355 | RTA00000616F.g.13.1 | M00005400A:D2 |
| 1107 | May 15, 1998 | 1488 | 356 | RTA00000615F.f.15.1 | M00004999D:E1 |
| 1108 | May 15, 1998 | 1488 | 357 | RTA00000591F.f.15.1 | M00005455A:D1 |

TABLE 1A-continued

Priority Appln Information

| SEQ ID NO: | Filed | Dkt No. | SEQ ID NO: | Sequence Name | Clone Name |
|---|---|---|---|---|---|
| 1109 | May 15, 1998 | 1488 | 358 | RTA00000592F.g.07.1 | M00006596A:F7 |
| 1110 | May 15, 1998 | 1488 | 359 | RTA00000625F.o.16.1 | M00006615D:F4 |
| 1111 | May 15, 1998 | 1488 | 360 | RTA00000622F.f.13.1 | M00007033D:F4 |
| 1112 | May 15, 1998 | 1488 | 361 | RTA00000619F.p.02.3 | M00006826B:H3 |
| 1113 | May 15, 1998 | 1488 | 362 | RTA00000625F.h.11.1 | M00005812C:F10 |
| 1114 | May 15, 1998 | 1488 | 363 | RTA00000591F.i.05.1 | M00005477C:D8 |
| 1115 | May 15, 1998 | 1488 | 364 | RTA00000622F.j.07.1 | M00007053B:C7 |
| 1116 | May 15, 1998 | 1488 | 365 | RTA00000619F.k.01.1 | M00006801A:G5 |
| 1117 | May 15, 1998 | 1488 | 366 | RTA00000619F.b.24.1 | M00006754B:D5 |
| 1118 | May 15, 1998 | 1488 | 367 | RTA00000619F.b.16.1 | M00006751A:F3 |
| 1119 | May 15, 1998 | 1488 | 368 | RTA00000618F.p.04.1 | M00006738A:E5 |
| 1120 | May 15, 1998 | 1488 | 369 | RTA00000615F.k.18.1 | M00005342A:D4 |
| 1121 | May 15, 1998 | 1488 | 370 | RTA00000618F.g.23.1 | M00006695B:F8 |
| 1122 | May 15, 1998 | 1488 | 371 | RTA00000618F.n.14.1 | M00006728D:G10 |
| 1123 | May 15, 1998 | 1488 | 372 | RTA00000619F.e.23.1 | M00006765B:H6 |
| 1124 | May 15, 1998 | 1488 | 373 | RTA00000617F.j.06.1 | M00005487A:H1 |
| 1125 | May 15, 1998 | 1488 | 374 | RTA00000622F.f.06.1 | M00007033A:H5 |
| 1126 | May 15, 1998 | 1488 | 375 | RTA00000622F.e.09.1 | M00007030C:F8 |
| 1127 | May 15, 1998 | 1488 | 376 | RTA00000624F.k.11.1 | M00005635C:F11 |
| 1128 | May 15, 1998 | 1488 | 377 | RTA00000619F.a.24.1 | M00006745A:A1 |
| 1129 | May 15, 1998 | 1488 | 378 | RTA00000625F.i.03.1 | M00005818C:G1 |
| 1130 | May 15, 1998 | 1488 | 379 | RTA00000590F.l.10.1 | M00005352D:E6 |
| 1131 | May 15, 1998 | 1488 | 380 | RTA00000623F.d.12.1 | M00007122B:A11 |
| 1132 | May 15, 1998 | 1488 | 381 | RTA00000622F.o.05.1 | M00007090B:A2 |
| 1133 | May 15, 1998 | 1488 | 382 | RTA00000623F.n.07.1 | M00007200B:C2 |
| 1134 | May 15, 1998 | 1488 | 383 | RTA00000621F.k.10.1 | M00006973C:E11 |
| 1135 | May 15, 1998 | 1488 | 384 | RTA00000616F.b.O5.1 | M00005377A:A4 |
| 1136 | May 15, 1998 | 1488 | 385 | RTA00000619F.p.11.4 | M00006828D:C12 |
| 1137 | May 15, 1998 | 1488 | 386 | RTA00000616F.d.15.1 | M00005388D:B11 |
| 1138 | May 15, 1998 | 1488 | 387 | RTA00000615F.b.07.1 | M00004839C:B1 |
| 1139 | May 15, 1998 | 1488 | 388 | RTA00000619F.f.19.1 | M00006771A:E6 |
| 1140 | May 15, 1998 | 1488 | 389 | RTA00000621F.l.06.1 | M00006976C:E9 |
| 1141 | May 15, 1998 | 1488 | 390 | RTA00000624F.m.08.1 | M00005646C:B9 |
| 1142 | May 15, 1998 | 1488 | 391 | RTA00000617F.k.13.1 | M00005493B:E1 |
| 1143 | May 15, 1998 | 1488 | 392 | RTA00000592F.h.07.1 | M00006630B:H6 |
| 1144 | May 15, 1998 | 1488 | 393 | RTA00000619F.f.24.1 | M00006771B:F3 |
| 1145 | May 15, 1998 | 1488 | 394 | RTA00000622F.e.20.1 | M00007032A:F11 |
| 1146 | May 15, 1998 | 1488 | 395 | RTA00000623F.h.23.1 | M00007152A:B4 |
| 1147 | May 15, 1998 | 1488 | 396 | RTA00000626F.b.20.1 | M00006635C:B10 |
| 1148 | May 15, 1998 | 1488 | 397 | RTA00000623F.n.03.1 | M00007199D:B7 |
| 1149 | May 15, 1998 | 1488 | 398 | RTA00000625F.i.02.1 | M00005818C:E8 |
| 1150 | May 15, 1998 | 1488 | 399 | RTA00000622F.i.08.1 | M00007047B:D1 |
| 1151 | May 15, 1998 | 1488 | 400 | RTA00000621F.c.23.1 | M00006937B:G9 |
| 1152 | May 15, 1998 | 1488 | 401 | RTA00000619F.f.11.1 | M00006769D:A4 |
| 1153 | May 15, 1998 | 1488 | 402 | RTA00000621F.b.14.1 | M00006934A:G2 |
| 1154 | May 15, 1998 | 1488 | 403 | RTA00000621F.g.10.1 | M00006953B:H10 |
| 1155 | May 15, 1998 | 1488 | 404 | RTA00000619F.p.22.3 | M00006832A:F5 |
| 1156 | May 15, 1998 | 1488 | 405 | RTA00000590F.p.23.1 | M00005399D:B2 |
| 1157 | May 15, 1998 | 1488 | 406 | RTA00000621F.m.23.1 | M00006987B:F4 |
| 1158 | May 15, 1998 | 1488 | 407 | RTA00000592F.d.20.1 | M00005772A:F3 |
| 1159 | May 15, 1998 | 1488 | 408 | RTA00000624F.m.14.1 | M00005647D:D9 |
| 1160 | May 15, 1998 | 1488 | 409 | RTA00000617F.a.08.1 | M00005448D:E8 |
| 1161 | May 15, 1998 | 1488 | 410 | RTA00000620F.i.04.1 | M00006877B:E5 |
| 1162 | May 15, 1998 | 1488 | 411 | RTA00000623F.l.12.1 | M00007188A:D3 |
| 1163 | May 15, 1998 | 1488 | 412 | RTA00000591F.b.02.1 | M00005411D:E5 |
| 1164 | May 15, 1998 | 1488 | 413 | RTA00000623F.h.07.1 | M00007146D:G1 |
| 1165 | May 15, 1998 | 1488 | 414 | RTA00000624F.p.21.1 | M00005703C:B1 |
| 1166 | May 15, 1998 | 1488 | 415 | RTA00000623F.j.09.2 | M00007163A:F11 |
| 1167 | May 15, 1998 | 1488 | 416 | RTA00000623F.l.17.1 | M00007189D:A9 |
| 1168 | May 15, 1998 | 1488 | 417 | RTA00000619F.p.18.3 | M00006831B:B4 |
| 1169 | May 15, 1998 | 1488 | 418 | RTA00000622F.h.06.1 | M00007041B:G1 |
| 1170 | May 15, 1998 | 1488 | 419 | RTA00000591F.m.20.1 | M00005519C:F8 |
| 1171 | May 15, 1998 | 1488 | 420 | RTA00000623F.h.10.1 | M00007148B:C6 |
| 1172 | May 15, 1998 | 1488 | 421 | RTA00000619F.i.10.1 | M00006790D:A5 |
| 1173 | May 15, 1998 | 1488 | 422 | RTA00000625F.b.13.1 | M00005711A:H1 |
| 1174 | May 15, 1998 | 1488 | 423 | RTA00000623F.e.16.1 | M00007129A:E4 |
| 1175 | May 15, 1998 | 1488 | 424 | RTA00000625F.k.12.1 | M00006582D:E5 |
| 1176 | May 15, 1998 | 1488 | 425 | RTA00000624F.i.09.1 | M00005626A:B11 |
| 1177 | May 15, 1998 | 1488 | 426 | RTA00000625F.k.09.1 | M00006582A:B9 |
| 1178 | May 15, 1998 | 1488 | 427 | RTA00000622F.k.10.1 | M00007062A:D3 |
| 1179 | May 15, 1998 | 1488 | 428 | RTA00000616F.h.12.1 | M00005403D:E11 |
| 1180 | May 15, 1998 | 1488 | 429 | RTA00000623F.k.07.1 | M00007170D:A10 |
| 1181 | May 15, 1998 | 1488 | 430 | RTA00000620F.p.18.1 | M00006923B:H8 |

TABLE 1A-continued

Priority Appln Information

| SEQ ID NO: | Filed | Dkt No. | SEQ ID NO: | Sequence Name | Clone Name |
| --- | --- | --- | --- | --- | --- |
| 1182 | May 15, 1998 | 1488 | 431 | RTA00000620F.e.01.1 | M00006855D:H2 |
| 1183 | May 15, 1998 | 1488 | 432 | RTA00000616F.b.10.1 | M00005377D:F11 |
| 1184 | May 15, 1998 | 1488 | 433 | RTA00000615F.d.06.1 | M00004858D:E6 |
| 1185 | May 15, 1998 | 1488 | 434 | RTA00000592F.h.23.1 | M00006640B:H9 |
| 1186 | May 15, 1998 | 1488 | 435 | RTA00000622F.e.07.1 | M00007030A:G1 |
| 1187 | May 15, 1998 | 1488 | 436 | RTA00000617F.f.23.2 | M00005473D:E10 |
| 1188 | May 15, 1998 | 1488 | 437 | RTA00000620F.h.10.1 | M00006875A:A2 |
| 1189 | May 15, 1998 | 1488 | 438 | RTA00000615F.g.19.1 | M00005009B:A2 |
| 1190 | May 15, 1998 | 1488 | 439 | RTA00000626F.b.09.1 | M00006633C:E11 |
| 1191 | May 15, 1998 | 1488 | 440 | RTA00000626F.e.10.1 | M00006644D:C2 |
| 1192 | May 15, 1998 | 1488 | 441 | RTA00000591F.a.08.1 | M00005404C:F2 |
| 1193 | May 15, 1998 | 1488 | 442 | RTA00000622F.j.09.1 | M00007053B:H3 |
| 1194 | May 15, 1998 | 1488 | 443 | RTA00000591F.n.01.1 | M00005524C:B1 |
| 1195 | May 15, 1998 | 1488 | 444 | RTA00000623F.e.12.1 | M00007127B:A4 |
| 1196 | May 15, 1998 | 1488 | 445 | RTA00000625F.p.01.1 | M00006617B:D9 |
| 1197 | May 15, 1998 | 1488 | 446 | RTA00000623F.f.13.1 | M00007134C:F7 |
| 1198 | May 15, 1998 | 1488 | 447 | RTA00000620F.c.24.1 | M00006850C:D9 |
| 1199 | May 15, 1998 | 1488 | 448 | RTA00000618F.i.21.1 | M00006704D:D3 |
| 1200 | May 15, 1998 | 1488 | 449 | RTA00000617F.l.08.1 | M00005497C:E3 |
| 1201 | May 15, 1998 | 1488 | 450 | RTA00000619F.l.07.1 | M00006810D:A5 |
| 1202 | May 15, 1998 | 1488 | 451 | RTA00000624F.n.16.1 | M00005655B:C2 |
| 1203 | May 15, 1998 | 1488 | 452 | RTA00000621F.n.24.1 | M00006991D:G7 |
| 1204 | May 15, 1998 | 1488 | 453 | RTA00000621F.c.20.1 | M00006937B:F7 |
| 1205 | May 15, 1998 | 1488 | 454 | RTA00000623F.g.07.1 | M00007140D:C12 |
| 1206 | May 15, 1998 | 1488 | 455 | RTA00000591F.i.17.1 | M00005481C:A5 |
| 1207 | May 15, 1998 | 1488 | 456 | RTA00000626F.b.22.1 | M00006636A:B8 |
| 1208 | May 15, 1998 | 1488 | 457 | RTA00000620F.i.16.1 | M00006882D:F3 |
| 1209 | May 15, 1998 | 1488 | 458 | RTA00000623F.f.21.1 | M00007137D:C10 |
| 1210 | May 15, 1998 | 1488 | 459 | RTA00000591F.f.18.1 | M00005455A:G3 |
| 1211 | May 15, 1998 | 1488 | 460 | RTA00000616F.e.10.1 | M00005392C:C4 |
| 1212 | May 15, 1998 | 1488 | 461 | RTA00000619F.l.22.1 | M00006814A:F7 |
| 1213 | May 15, 1998 | 1488 | 462 | RTA00000591F.a.20.1 | M00005411A:C7 |
| 1214 | May 15, 1998 | 1488 | 463 | RTA00000623F.b.23.1 | M00007112B:C6 |
| 1215 | May 15, 1998 | 1488 | 464 | RTA00000621F.n.15.1 | M00006990B:H9 |
| 1216 | May 15, 1998 | 1488 | 465 | RTA00000620F.m.15.1 | M00006907D:C7 |
| 1217 | May 15, 1998 | 1488 | 466 | RTA00000591F.a.15.1 | M00005406D:B8 |
| 1218 | May 15, 1998 | 1488 | 467 | RTA00000620F.p.05.1 | M00006921B:C2 |
| 1219 | May 15, 1998 | 1488 | 468 | RTA00000620F.h.04.1 | M00006873B:G11 |
| 1220 | May 15, 1998 | 1488 | 469 | RTA00000592F.g.15.1 | M00006615B:F5 |
| 1221 | May 15, 1998 | 1488 | 470 | RTA00000625F.b.21.1 | M00005720A:D3 |
| 1222 | May 15, 1998 | 1488 | 471 | RTA00000621F.n.18.1 | M00006991A:E7 |
| 1223 | May 15, 1998 | 1488 | 472 | RTA00000591F.h.08.1 | M00005470B:E1 |
| 1224 | May 15, 1998 | 1488 | 473 | RTA00000591F.j.13.1 | M00005486C:B3 |
| 1225 | May 15, 1998 | 1488 | 474 | RTA00000626F.e.08.1 | M00006644C:E9 |
| 1226 | May 15, 1998 | 1488 | 475 | RTA00000623F.d.23.1 | M00007124C:A11 |
| 1227 | May 15, 1998 | 1488 | 476 | RTA00000592F.g.04.1 | M00006592A:D3 |
| 1228 | May 15, 1998 | 1488 | 477 | RTA00000590F.p.22.1 | M00005399B:F2 |
| 1229 | May 15, 1998 | 1488 | 478 | RTA00000590F.n.10.1 | M00005377A:D5 |
| 1230 | May 15, 1998 | 1488 | 479 | RTA00000623F.j.16.2 | M00007166B:E6 |
| 1231 | May 15, 1998 | 1488 | 480 | RTA00000619F.j.19.1 | M00006797B:D12 |
| 1232 | May 15, 1998 | 1488 | 481 | RTA00000621F.c.12.1 | M00006936B:F10 |
| 1233 | May 15, 1998 | 1488 | 482 | RTA00000618F.b.17.1 | M00006674B:F4 |
| 1234 | May 15, 1998 | 1488 | 483 | RTA00000621F.p.08.1 | M00006995D:A3 |
| 1235 | May 15, 1998 | 1488 | 484 | RTA00000626F.b.13.1 | M00006634B:C2 |
| 1236 | May 15, 1998 | 1488 | 485 | RTA00000623F.e.18.1 | M00007129A:G10 |
| 1237 | May 15, 1998 | 1488 | 486 | RTA00000625F.j.01.1 | M00005827B:H8 |
| 1238 | May 15, 1998 | 1488 | 487 | RTA00000625F.o.18.1 | M00006616C:H9 |
| 1239 | May 15, 1998 | 1488 | 488 | RTA00000623F.k.13.1 | M00007172D:C8 |
| 1240 | May 15, 1998 | 1488 | 489 | RTA00000623F.k.10.1 | M00007172A:A5 |
| 1241 | May 15, 1998 | 1488 | 490 | RTA00000626F.d.12.1 | M00006641A:B3 |
| 1242 | May 15, 1998 | 1488 | 491 | RTA00000626F.d.23.1 | M00006643A:E10 |
| 1243 | May 15, 1998 | 1488 | 492 | RTA00000623F.j.02.1 | M00007160C:B8 |
| 1244 | May 15, 1998 | 1488 | 493 | RTA00000618F.o.07.1 | M00006735A:H2 |
| 1245 | May 15, 1998 | 1488 | 494 | RTA00000620F.a.08.1 | M00006833B:E11 |
| 1246 | May 15, 1998 | 1488 | 495 | RTA00000623F.d.11.1 | M00007122A:G11 |
| 1247 | May 15, 1998 | 1488 | 496 | RTA00000623F.h.16.1 | M00007149D:G6 |
| 1248 | May 15, 1998 | 1488 | 497 | RTA00000624F.a.17.1 | M00005535B:F6 |
| 1249 | May 15, 1998 | 1488 | 498 | RTA00000621F.n.17.1 | M00006990D:D6 |
| 1250 | May 15, 1998 | 1488 | 499 | RTA00000625F.n.02.1 | M00006601C:E6 |
| 1251 | May 15, 1998 | 1488 | 500 | RTA00000591F.n.05.1 | M00005530B:E4 |
| 1252 | May 15, 1998 | 1488 | 501 | RTA00000622F.n.09.1 | M00007084B:A5 |
| 1253 | May 15, 1998 | 1488 | 502 | RTA00000617F.l.05.1 | M00005497C:C10 |
| 1254 | May 15, 1998 | 1488 | 503 | RTA00000623F.j.08.2 | M00007163A:B10 |

TABLE 1A-continued

Priority Appln Information

| SEQ ID NO: | Filed | Dkt No. | SEQ ID NO: | Sequence Name | Clone Name |
|---|---|---|---|---|---|
| 1255 | May 15, 1998 | 1488 | 504 | RTA00000626F.g.02.1 | M00006656C:C10 |
| 1256 | May 15, 1998 | 1488 | 505 | RTA00000617F.l.06.1 | M00005497C:C12 |
| 1257 | May 15, 1998 | 1488 | 506 | RTA00000592F.a.06.1 | M00005635B:A6 |
| 1258 | May 15, 1998 | 1488 | 507 | RTA00000591F.j.11.1 | M00005485C:A3 |
| 1259 | May 15, 1998 | 1488 | 508 | RTA00000622F.h.21.1 | M00007046A:D2 |
| 1260 | May 15, 1998 | 1488 | 509 | RTA00000591F.h.03.1 | M00005468D:F4 |
| 1261 | May 15, 1998 | 1488 | 510 | RTA00000620F.g.22.1 | M00006872B:G1 |
| 1262 | May 15, 1998 | 1488 | 511 | RTA00000617F.c.05.1 | M00005456B:E3 |
| 1263 | May 15, 1998 | 1488 | 512 | RTA00000616F.e.15.3 | M00005393A:E11 |
| 1264 | May 15, 1998 | 1488 | 513 | RTA00000616F.f.15.3 | M00005396B:C4 |
| 1265 | May 15, 1998 | 1488 | 514 | RTA00000622F.c.11.1 | M00007014D:C5 |
| 1266 | May 15, 1998 | 1488 | 515 | RTA00000621F.f.12.1 | M00006949B:F3 |
| 1267 | May 15, 1998 | 1488 | 516 | RTA00000603F.c.23.1 | M00006720C:C11 |
| 1268 | May 15, 1998 | 1488 | 517 | RTA00000640F.a.23.1 | M00005817D:E12 |
| 1269 | May 15, 1998 | 1488 | 518 | RTA00000618F.h.15.1 | M00006699B:C7 |
| 1270 | May 15, 1998 | 1488 | 519 | RTA00000616F.p.22.1 | M00005446C:D12 |
| 1271 | May 15, 1998 | 1488 | 520 | RTA00000621F.p.18.1 | M00006997D:B3 |
| 1272 | May 15, 1998 | 1488 | 521 | RTA00000615F.b.10.1 | M00004840C:H5 |
| 1273 | May 15, 1998 | 1488 | 522 | RTA00000590F.l.05.1 | M00005332A:H10 |
| 1274 | May 15, 1998 | 1488 | 523 | RTA00000619F.g.06.1 | M00006774D:C1 |
| 1275 | May 15, 1998 | 1488 | 524 | RTA00000619F.c.24.1 | M00006757D:E4 |
| 1276 | May 15, 1998 | 1488 | 525 | RTA00000619F.f.23.1 | M00006771B:A9 |
| 1277 | May 15, 1998 | 1489 | 1 | RTA00000639F.e.11.1 | M00023011A:A6 |
| 1278 | May 15, 1998 | 1489 | 2 | RTA00000631F.e.20.1 | M00022386B:D11 |
| 1279 | May 15, 1998 | 1489 | 3 | RTA00000631F.e.15.1 | M00022386A:A7 |
| 1280 | May 15, 1998 | 1489 | 4 | RTA00000639F.d.02.1 | M00022993A:F2 |
| 1281 | May 15, 1998 | 1489 | 5 | RTA00000639F.f.10.1 | M00023021A:H8 |
| 1282 | May 15, 1998 | 1489 | 6 | RTA00000628F.e.17.1 | M00021862D:F1 |
| 1283 | May 15, 1998 | 1489 | 7 | RTA00000627F.p.18.1 | M00021670B:G11 |
| 1284 | May 15, 1998 | 1489 | 8 | RTA00000633F.o.22.1 | M00022901D:C9 |
| 1285 | May 15, 1998 | 1489 | 9 | RTA00000632F.b.04.1 | M00022493C:B7 |
| 1286 | May 15, 1998 | 1489 | 10 | RTA00000639F.g.14.1 | M00023034C:E5 |
| 1287 | May 15, 1998 | 1489 | 11 | RTA00000631F.p.10.1 | M00022474A:H9 |
| 1288 | May 15, 1998 | 1489 | 12 | RTA00000628F.c.20.1 | M00021828A:C8 |
| 1289 | May 15, 1998 | 1489 | 13 | RTA00000630F.o.20.1 | M00022289A:D5 |
| 1290 | May 15, 1998 | 1489 | 14 | RTA00000630F.e.18.1 | M00022202C:F11 |
| 1291 | May 15, 1998 | 1489 | 15 | RTA00000628F.b.18.1 | M00021690C:B7 |
| 1292 | May 15, 1998 | 1489 | 16 | RTA00000590F.j.07.1 | M00004873C:C10 |
| 1293 | May 15, 1998 | 1489 | 17 | RTA00000630F.a.19.1 | M00022169C:C2 |
| 1294 | May 15, 1998 | 1489 | 18 | RTA00000630F.i.02.1 | M00022226D:A7 |
| 1295 | May 15, 1998 | 1489 | 19 | RTA00000631F.a.22.1 | M00022364C:G12 |
| 1296 | May 15, 1998 | 1489 | 20 | RTA00000630F.l.19.1 | M00022255D:E3 |
| 1297 | May 15, 1998 | 1489 | 21 | RTA00000633F.a.15.1 | M00022661D:H1 |
| 1298 | May 15, 1998 | 1489 | 22 | RTA00000639F.c.06.1 | M00022972D:C10 |
| 1299 | May 15, 1998 | 1489 | 23 | RTA00000630F.p.23.1 | M00022305C:A1 |
| 1300 | May 15, 1998 | 1489 | 24 | RTA00000629F.o.19.2 | M00022150D:D11 |
| 1301 | May 15, 1998 | 1489 | 25 | RTA00000632F.j.18.1 | M00022599D:E7 |
| 1302 | May 15, 1998 | 1489 | 26 | RTA00000630F.o.21.1 | M00022289D:B6 |
| 1303 | May 15, 1998 | 1489 | 27 | RTA00000629F.l.02.1 | M00022117C:G7 |
| 1304 | May 15, 1998 | 1489 | 28 | RTA00000628F.e.13.1 | M00021861C:A2 |
| 1305 | May 15, 1998 | 1489 | 29 | RTA00000632F.j.02.1 | M00022587C:G4 |
| 1306 | May 15, 1998 | 1489 | 30 | RTA00000639F.e.01.1 | M00023003C:A3 |
| 1307 | May 15, 1998 | 1489 | 31 | RTA00000631F.f.01.1 | M00022386C:D7 |
| 1308 | May 15, 1998 | 1489 | 32 | RTA00000630F.p.22.1 | M00022305A:H11 |
| 1309 | May 15, 1998 | 1489 | 33 | RTA00000628F.l.05.1 | M00021946D:C11 |
| 1310 | May 15, 1998 | 1489 | 34 | RTA00000629F.b.06.1 | M00022049A:A2 |
| 1311 | May 15, 1998 | 1489 | 35 | RTA00000628F.g.20.1 | M00021892B:H3 |
| 1312 | May 15, 1998 | 1489 | 36 | RTA00000628F.n.11.1 | M00021982C:F8 |
| 1313 | May 15, 1998 | 1489 | 37 | RTA00000593F.e.21.1 | M00022074D:F11 |
| 1314 | May 15, 1998 | 1489 | 38 | RTA00000633F.c.07.1 | M00022674D:G4 |
| 1315 | May 15, 1998 | 1489 | 39 | RTA00000629F.k.17.1 | M00022110A:E4 |
| 1316 | May 15, 1998 | 1489 | 40 | RTA00000633F.a.11.1 | M00022661B:E11 |
| 1317 | May 15, 1998 | 1489 | 41 | RTA00000629F.e.16.1 | M00022068D:D12 |
| 1318 | May 15, 1998 | 1489 | 42 | RTA00000631F.c.01.1 | M00022372B:D3 |
| 1319 | May 15, 1998 | 1489 | 43 | RTA00000630F.n.22.1 | M00022278C:E3 |
| 1320 | May 15, 1998 | 1489 | 44 | RTA00000628F.j.14.1 | M00021927B:F1 |
| 1321 | May 15, 1998 | 1489 | 45 | RTA00000631F.l.14.1 | M00022449D:F6 |
| 1322 | May 15, 1998 | 1489 | 46 | RTA00000631F.j.06.1 | M00022423B:D3 |
| 1323 | May 15, 1998 | 1489 | 47 | RTA00000630F.b.17.1 | M00022175A:A11 |
| 1324 | May 15, 1998 | 1489 | 48 | RTA00000593F.i.08.2 | M00022218C:B6 |
| 1325 | May 15, 1998 | 1489 | 49 | RTA00000631F.l.12.1 | M00022449C:B1 |
| 1326 | May 15, 1998 | 1489 | 50 | RTA00000628F.m.20.1 | M00021978A:F8 |
| 1327 | May 15, 1998 | 1489 | 51 | RTA00000632F.c.02.1 | M00022504B:E3 |

TABLE 1A-continued

Priority Appln Information

| SEQ ID NO: | Filed | Dkt No. | SEQ ID NO: | Sequence Name | Clone Name |
|---|---|---|---|---|---|
| 1328 | May 15, 1998 | 1489 | 52 | RTA00000632F.h.03.1 | M00022565C:H2 |
| 1329 | May 15, 1998 | 1489 | 53 | RTA00000592F.l.16.1 | M00007977C:E8 |
| 1330 | May 15, 1998 | 1489 | 54 | RTA00000630F.c.01.1 | M00022176A:E8 |
| 1331 | May 15, 1998 | 1489 | 55 | RTA00000593F.e.19.1 | M00022071C:D9 |
| 1332 | May 15, 1998 | 1489 | 56 | RTA00000632F.a.10.1 | M00022490C:C1 |
| 1333 | May 15, 1998 | 1489 | 57 | RTA00000632F.f.12.1 | M00022536B:B4 |
| 1334 | May 15, 1998 | 1489 | 58 | RTA00000630F.m.06.1 | M00022259B:G2 |
| 1335 | May 15, 1998 | 1489 | 59 | RTA00000629F.e.07.1 | M00022067D:C5 |
| 1336 | May 15, 1998 | 1489 | 60 | RTA00000627F.k.19.1 | M00021618D:D7 |
| 1337 | May 15, 1998 | 1489 | 61 | RTA00000629F.o.15.2 | M00022149B:D5 |
| 1338 | May 15, 1998 | 1489 | 62 | RTA00000592F.o.02.1 | M00008015D:E9 |
| 1339 | May 15, 1998 | 1489 | 63 | RTA00000628F.h.18.1 | M00021906C:G11 |
| 1340 | May 15, 1998 | 1489 | 64 | RTA00000632F.h.23.1 | M00022578D:A8 |
| 1341 | May 15, 1998 | 1489 | 65 | RTA00000639F.h.18.1 | M00023103A:E11 |
| 1342 | May 15, 1998 | 1489 | 66 | RTA00000630F.p.11.1 | M00022296B:C11 |
| 1343 | May 15, 1998 | 1489 | 67 | RTA00000632F.o.18.1 | M00022651D:C6 |
| 1344 | May 15, 1998 | 1489 | 68 | RTA00000629F.a.24.1 | M00022032A:E7 |
| 1345 | May 15, 1998 | 1489 | 69 | RTA00000633F.f.19.1 | M00022708D:G10 |
| 1346 | May 15, 1998 | 1489 | 70 | RTA00000627F.n.04.1 | M00021640A:G3 |
| 1347 | May 15, 1998 | 1489 | 71 | RTA00000630F.p.04.1 | M00022294A:D11 |
| 1348 | May 15, 1998 | 1489 | 72 | RTA00000633F.h.21.1 | M00022730A:E4 |
| 1349 | May 15, 1998 | 1489 | 73 | RTA00000632F.d.12.1 | M00022515D:C4 |
| 1350 | May 15, 1998 | 1489 | 74 | RTA00000627F.o.23.1 | M00021660C:G4 |
| 1351 | May 15, 1998 | 1489 | 75 | RTA00000628F.j.12.1 | M00021927A:C11 |
| 1352 | May 15, 1998 | 1489 | 76 | RTA00000632F.f.03.1 | M00022531B:D7 |
| 1353 | May 15, 1998 | 1489 | 77 | RTA00000593F.o.03.1 | M00022549B:G7 |
| 1354 | May 15, 1998 | 1489 | 78 | RTA00000631F.b.06.1 | M00022366B:E9 |
| 1355 | May 15, 1998 | 1489 | 79 | RTA00000633F.g.15.1 | M00022716D:D8 |
| 1356 | May 15, 1998 | 1489 | 80 | RTA00000594F.b.04.1 | M00022828C:E4 |
| 1357 | May 15, 1998 | 1489 | 81 | RTA00000623F.o.14.1 | M00007929B:H10 |
| 1358 | May 15, 1998 | 1489 | 82 | RTA00000632F.g.02.1 | M00022551A:G3 |
| 1359 | May 15, 1998 | 1489 | 83 | RTA00000629F.h.11.1 | M00022084B:F4 |
| 1360 | May 15, 1998 | 1489 | 84 | RTA00000632F.b.17.1 | M00022498C:C8 |
| 1361 | May 15, 1998 | 1489 | 85 | RTA00000631F.m.04.1 | M00022452C:B3 |
| 1362 | May 15, 1998 | 1489 | 86 | RTA00000627F.k.02.1 | M00021614B:G12 |
| 1363 | May 15, 1998 | 1489 | 87 | RTA00000631F.n.06.1 | M00022457C:B1 |
| 1364 | May 15, 1998 | 1489 | 88 | RTA00000633F.i.15.1 | M00022737A:C8 |
| 1365 | May 15, 1998 | 1489 | 89 | RTA00000639F.f.11.1 | M00023023A:B12 |
| 1366 | May 15, 1998 | 1489 | 90 | RTA00000630F.j.04.1 | M00022236D:A3 |
| 1367 | May 15, 1998 | 1489 | 91 | RTA00000630F.j.14.1 | M00022239D:A7 |
| 1368 | May 15, 1998 | 1489 | 92 | RTA00000627F.k.24.1 | M00021619B:G10 |
| 1369 | May 15, 1998 | 1489 | 93 | RTA00000630F.j.13.1 | M00022239B:B7 |
| 1370 | May 15, 1998 | 1489 | 94 | RTA00000629F.j.07.1 | M00022094B:G10 |
| 1371 | May 15, 1998 | 1489 | 95 | RTA00000628F.m.02.1 | M00021964A:C4 |
| 1372 | May 15, 1998 | 1489 | 96 | RTA00000639F.g.08.1 | M00023033A:E10 |
| 1373 | May 15, 1998 | 1489 | 97 | RTA00000628F.i.05.1 | M00021910A:C10 |
| 1374 | May 15, 1998 | 1489 | 98 | RTA00000639F.a.16.1 | M00022953B:C7 |
| 1375 | May 15, 1998 | 1489 | 99 | RTA00000633F.c.21.1 | M00022682A:F12 |
| 1376 | May 15, 1998 | 1489 | 100 | RTA00000639F.b.03.1 | M00022960D:E8 |
| 1377 | May 15, 1998 | 1489 | 101 | RTA00000633F.b.05.1 | M00022666C:H11 |
| 1378 | May 15, 1998 | 1489 | 102 | RTA00000631F.h.05.2 | M00022412A:C8 |
| 1379 | May 15, 1998 | 1489 | 103 | RTA00000628F.h.14.1 | M00021905B:A1 |
| 1380 | May 15, 1998 | 1489 | 104 | RTA00000633F.b.03.1 | M00022666B:E12 |
| 1381 | May 15, 1998 | 1489 | 105 | RTA00000632F.g.08.1 | M00022556B:G2 |
| 1382 | May 15, 1998 | 1489 | 106 | RTA00000593F.g.18.1 | M00022171D:B8 |
| 1383 | May 15, 1998 | 1489 | 107 | RTA00000592F.p.10.1 | M00008061A:F2 |
| 1384 | May 15, 1998 | 1489 | 108 | RTA00000639F.f.19.1 | M00023028A:A2 |
| 1385 | May 15, 1998 | 1489 | 109 | RTA00000630F.f.04.1 | M00022206B:G6 |
| 1386 | May 15, 1998 | 1489 | 110 | RTA00000633F.o.02.1 | M00022893C:H11 |
| 1387 | May 15, 1998 | 1489 | 111 | RTA00000632F.b.12.1 | M00022495C:G5 |
| 1388 | May 15, 1998 | 1489 | 112 | RTA00000632F.g.20.1 | M00022562C:H10 |
| 1389 | May 15, 1998 | 1489 | 113 | RTA00000593F.f.12.1 | M00022109B:A11 |
| 1390 | May 15, 1998 | 1489 | 114 | RTA00000633F.c.19.1 | M00022681C:H2 |
| 1391 | May 15, 1998 | 1489 | 115 | RTA00000629F.e.12.1 | M00022068B:H11 |
| 1392 | May 15, 1998 | 1489 | 116 | RTA00000629F.j.01.1 | M00022093A:A5 |
| 1393 | May 15, 1998 | 1489 | 117 | RTA00000627F.m.07.1 | M00021625A:C7 |
| 1394 | May 15, 1998 | 1489 | 118 | RTA00000633F.n.12.1 | M00022856C:B11 |
| 1395 | May 15, 1998 | 1489 | 119 | RTA00000632F.e.15.1 | M00022527D:B3 |
| 1396 | May 15, 1998 | 1489 | 120 | RTA00000632F.a.09.1 | M00022490C:A8 |
| 1397 | May 15, 1998 | 1489 | 121 | RTA00000631F.k.12.1 | M00022439A:E7 |
| 1398 | May 15, 1998 | 1489 | 122 | RTA00000628F.c.02.1 | M00021694B:A7 |
| 1399 | May 15, 1998 | 1489 | 123 | RTA00000632F.f.10.1 | M00022535D:B11 |
| 1400 | May 15, 1998 | 1489 | 124 | RTA00000631F.f.11.1 | M00022389B:H4 |

TABLE 1A-continued

Priority Appln Information

| SEQ ID NO: | Filed | Dkt No. | SEQ ID NO: | Sequence Name | Clone Name |
|---|---|---|---|---|---|
| 1401 | May 15, 1998 | 1489 | 125 | RTA00000633F.n.06.1 | M00022854D:H7 |
| 1402 | May 15, 1998 | 1489 | 126 | RTA00000628F.l.14.1 | M00021954A:A3 |
| 1403 | May 15, 1998 | 1489 | 127 | RTA00000632F.k.10.1 | M00022607B:A4 |
| 1404 | May 15, 1998 | 1489 | 128 | RTA00000629F.b.08.1 | M00022049A:D6 |
| 1405 | May 15, 1998 | 1489 | 129 | RTA00000629F.l.10.1 | M00022122D:D6 |
| 1406 | May 15, 1998 | 1489 | 130 | RTA00000632F.c.04.1 | M00022505D:A12 |
| 1407 | May 15, 1998 | 1489 | 131 | RTA00000630F.h.22.1 | M00022221D:E8 |
| 1408 | May 15, 1998 | 1489 | 132 | RTA00000593F.e.18.1 | M00022070B:C10 |
| 1409 | May 15, 1998 | 1489 | 133 | RTA00000630F.l.02.1 | M00022252C:E6 |
| 1410 | May 15, 1998 | 1489 | 134 | RTA00000632F.k.20.1 | M00022613D:C4 |
| 1411 | May 15, 1998 | 1489 | 135 | RTA00000628F.p.01.1 | M00022005C:G3 |
| 1412 | May 15, 1998 | 1489 | 136 | RTA00000631F.l.01.1 | M00022444A:A11 |
| 1413 | May 15, 1998 | 1489 | 137 | RTA00000628F.a.16.1 | M00021678A:B8 |
| 1414 | May 15, 1998 | 1489 | 138 | RTA00000632F.j.14.1 | M00022598A:F11 |
| 1415 | May 15, 1998 | 1489 | 139 | RTA00000628F.e.06.1 | M00021859A:D4 |
| 1416 | May 15, 1998 | 1489 | 140 | RTA00000631F.n.08.1 | M00022458B:E6 |
| 1417 | May 15, 1998 | 1489 | 141 | RTA00000630F.g.18.1 | M00022216D:C1 |
| 1418 | May 15, 1998 | 1489 | 142 | RTA00000628F.m.08.1 | M00021967D:E8 |
| 1419 | May 15, 1998 | 1489 | 143 | RTA00000592F.k.12.1 | M00007961A:B1 |
| 1420 | May 15, 1998 | 1489 | 144 | RTA00000631F.e.22.1 | M00022386C:A4 |
| 1421 | May 15, 1998 | 1489 | 145 | RTA00000628F.b.21.1 | M00021692A:E3 |
| 1422 | May 15, 1998 | 1489 | 146 | RTA00000631F.d.13.1 | M00022381C:C12 |
| 1423 | May 15, 1998 | 1489 | 147 | RTA00000629F.p.04.2 | M00022153D:D11 |
| 1424 | May 15, 1998 | 1489 | 148 | RTA00000628F.b.01.1 | M00021680B:C1 |
| 1425 | May 15, 1998 | 1489 | 149 | RTA00000630F.c.19.1 | M00022183A:G3 |
| 1426 | May 15, 1998 | 1489 | 150 | RTA00000593F.l.06.1 | M00022404D:G5 |
| 1427 | May 15, 1998 | 1489 | 151 | RTA00000628F.c.11.1 | M00021698B:B12 |
| 1428 | May 15, 1998 | 1489 | 152 | RTA00000630F.l.05.1 | M00022253B:E6 |
| 1429 | May 15, 1998 | 1489 | 153 | RTA00000628F.b.22.1 | M00021692C:E6 |
| 1430 | May 15, 1998 | 1489 | 154 | RTA00000633F.g.19.1 | M00022718D:G5 |
| 1431 | May 15, 1998 | 1489 | 155 | RTA00000629F.p.10.2 | M00022157B:A10 |
| 1432 | May 15, 1998 | 1489 | 156 | RTA00000628F.b.17.1 | M00021690B:B6 |
| 1433 | May 15, 1998 | 1489 | 157 | RTA00000627F.j.18.1 | M00021611D:H3 |
| 1434 | May 15, 1998 | 1489 | 158 | RTA00000627F.p.10.1 | M00021665A:D4 |
| 1435 | May 15, 1998 | 1489 | 159 | RTA00000628F.e.15.1 | M00021862A:A4 |
| 1436 | May 15, 1998 | 1489 | 160 | RTA00000630F.h.12.1 | M00022218D:B12 |
| 1437 | May 15, 1998 | 1489 | 161 | RTA00000628F.i.08.1 | M00021912B:H11 |
| 1438 | May 15, 1998 | 1489 | 162 | RTA00000630F.c.09.1 | M00022178D:H1 |
| 1439 | May 15, 1998 | 1489 | 163 | RTA00000633F.o.08.1 | M00022897A:F4 |
| 1440 | May 15, 1998 | 1489 | 164 | RTA00000628F.l.07.1 | M00021947A:C1 |
| 1441 | May 15, 1998 | 1489 | 165 | RTA00000628F.n.18.1 | M00021983D:B10 |
| 1442 | May 15, 1998 | 1489 | 166 | RTA00000630F.l.10.1 | M00022254C:D8 |
| 1443 | May 15, 1998 | 1489 | 167 | RTA00000632F.i.01.1 | M00022578D:F3 |
| 1444 | May 15, 1998 | 1489 | 168 | RTA00000629F.j.04.1 | M00022093D:B10 |
| 1445 | May 15, 1998 | 1489 | 169 | RTA00000627F.j.16.1 | M00021611D:D5 |
| 1446 | May 15, 1998 | 1489 | 170 | RTA00000629F.e.20.1 | M00022069D:G2 |
| 1447 | May 15, 1998 | 1489 | 171 | RTA00000632F.h.21.1 | M00022578C:B7 |
| 1448 | May 15, 1998 | 1489 | 172 | RTA00000629F.p.09.2 | M00022157A:F12 |
| 1449 | May 15, 1998 | 1489 | 173 | RTA00000631F.d.22.1 | M00022382D:H11 |
| 1450 | May 15, 1998 | 1489 | 174 | RTA00000630F.l.14.1 | M00022255A:C8 |
| 1451 | May 15, 1998 | 1489 | 175 | RTA00000633F.h.12.1 | M00022725C:E9 |
| 1452 | May 15, 1998 | 1489 | 176 | RTA00000630F.i.11.1 | M00022231C:A4 |
| 1453 | May 15, 1998 | 1489 | 177 | RTA00000632F.a.05.1 | M00022489C:A8 |
| 1454 | May 15, 1998 | 1489 | 178 | RTA00000629F.g.21.1 | M00022081C:G11 |
| 1455 | May 15, 1998 | 1489 | 179 | RTA00000632F.e.12.1 | M00022527A:E5 |
| 1456 | May 15, 1998 | 1489 | 180 | RTA00000632F.g.11.1 | M00022557B:A8 |
| 1457 | May 15, 1998 | 1489 | 181 | RTA00000629F.f.22.1 | M00022075D:F5 |
| 1458 | May 15, 1998 | 1489 | 182 | RTA00000630F.j.12.1 | M00022239A:A10 |
| 1459 | May 15, 1998 | 1489 | 183 | RTA00000629F.h.16.1 | M00022085C:C4 |
| 1460 | May 15, 1998 | 1489 | 184 | RTA00000633F.j.13.1 | M00022745A:B4 |
| 1461 | May 15, 1998 | 1489 | 185 | RTA00000633F.h.10.1 | M00022725C:B3 |
| 1462 | May 15, 1998 | 1489 | 186 | RTA00000632F.b.05.1 | M00022493C:C6 |
| 1463 | May 15, 1998 | 1489 | 187 | RTA00000633F.h.18.1 | M00022727B:C5 |
| 1464 | May 15, 1998 | 1489 | 188 | RTA00000633F.h.13.1 | M00022726A:A6 |
| 1465 | May 15, 1998 | 1489 | 189 | RTA00000630F.i.09.1 | M00022231A:F12 |
| 1466 | May 15, 1998 | 1489 | 190 | RTA00000593F.h.03.1 | M00022176C:A8 |
| 1467 | May 15, 1998 | 1489 | 191 | RTA00000632F.c.18.1 | M00022509D:F6 |
| 1468 | May 15, 1998 | 1489 | 192 | RTA00000593F.f.03.1 | M00022081C:B11 |
| 1469 | May 15, 1998 | 1489 | 193 | RTA00000627F.n.21.1 | M00021653A:G7 |
| 1470 | May 15, 1998 | 1489 | 194 | RTA00000631F.g.18.2 | M00022407C:H11 |
| 1471 | May 15, 1998 | 1489 | 195 | RTA00000639F.c.14.1 | M00022980B:E11 |
| 1472 | May 15, 1998 | 1489 | 196 | RTA00000633F.m.08.1 | M00022824C:H11 |
| 1473 | May 15, 1998 | 1489 | 197 | RTA00000627F.m.10.1 | M00021629D:D5 |

TABLE 1A-continued

Priority Appln Information

| SEQ ID NO: | Filed | Dkt No. | SEQ ID NO: | Sequence Name | Clone Name |
|---|---|---|---|---|---|
| 1474 | May 15, 1998 | 1489 | 198 | RTA00000632F.h.20.1 | M00022578B:G5 |
| 1475 | May 15, 1998 | 1489 | 199 | RTA00000627F.o.09.1 | M00021657B:C8 |
| 1476 | May 15, 1998 | 1489 | 200 | RTA00000632F.j.06.1 | M00022594B:H12 |
| 1477 | May 15, 1998 | 1489 | 201 | RTA00000632F.d.07.1 | M00022514A:D4 |
| 1478 | May 15, 1998 | 1489 | 202 | RTA00000629F.d.23.1 | M00022064C:H7 |
| 1479 | May 15, 1998 | 1489 | 203 | RTA00000629F.m.05.1 | M00022128A:D4 |
| 1480 | May 15, 1998 | 1489 | 204 | RTA00000639F.b.08.1 | M00022963A:D11 |
| 1481 | May 15, 1998 | 1489 | 205 | RTA00000627F.l.21.1 | M00021624A:D7 |
| 1482 | May 15, 1998 | 1489 | 206 | RTA00000628F.j.16.1 | M00021927D:D12 |
| 1483 | May 15, 1998 | 1489 | 207 | RTA00000628F.b.08.1 | M00021681C:B10 |
| 1484 | May 15, 1998 | 1489 | 208 | RTA00000630F.e.10.1 | M00022199C:F3 |
| 1485 | May 15, 1998 | 1489 | 209 | RTA00000639F.b.21.1 | M00022968A:F2 |
| 1486 | May 15, 1998 | 1489 | 210 | RTA00000631F.h.04.1 | M00022411D:G9 |
| 1487 | May 15, 1998 | 1489 | 211 | RTA00000639F.c.15.1 | M00022980C:A9 |
| 1488 | May 15, 1998 | 1489 | 212 | RTA00000631F.d.11.1 | M00022381A:F5 |
| 1489 | May 15, 1998 | 1489 | 213 | RTA00000633F.e.18.1 | M00022698C:E6 |
| 1490 | May 15, 1998 | 1489 | 214 | RTA00000615F.e.19.1 | M00004875A:G9 |
| 1491 | May 15, 1998 | 1489 | 215 | RTA00000629F.n.11.2 | M00022139A:C1 |
| 1492 | May 15, 1998 | 1489 | 216 | RTA0000063LF.g.11.2 | M00022404B:H5 |
| 1493 | May 15, 1998 | 1489 | 217 | RTA00000630F.o.18.1 | M00022288C:D4 |
| 1494 | May 15, 1998 | 1489 | 218 | RTA00000633F.h.22.1 | M00022730D:E10 |
| 1495 | May 15, 1998 | 1489 | 219 | RTA00000633F.e.24.1 | M00022701B:B12 |
| 1496 | May 15, 1998 | 1489 | 220 | RTA00000633F.o.19.1 | M00022900D:E8 |
| 1497 | May 15, 1998 | 1489 | 221 | RTA00000630F.e.04.1 | M00022198A:C12 |
| 1498 | May 15, 1998 | 1489 | 222 | RTA00000627F.o.01.1 | M00021654C:A2 |
| 1499 | May 15, 1998 | 1489 | 223 | RTA00000629F.k.21.1 | M00022114C:B2 |
| 1500 | May 15, 1998 | 1489 | 224 | RTA00000631F.g.04.1 | M00022399C:A10 |
| 1501 | May 15, 1998 | 1489 | 225 | RTA00000630F.m.03.1 | M00022258C:F6 |
| 1502 | May 15, 1998 | 1489 | 226 | RTA00000629F.i.08.1 | M00022090A:G8 |
| 1503 | May 15, 1998 | 1489 | 227 | RTA00000593F.d.02.2 | M00021682B:D12 |
| 1504 | May 15, 1998 | 1489 | 228 | RTA00000631F.a.24.1 | M00022365A:A1 |
| 1505 | May 15, 1998 | 1489 | 229 | RTA00000629F.p.06.2 | M00022154A:C1 |
| 1506 | May 15, 1998 | 1489 | 230 | RTA00000633F.n.09.1 | M00022856B:D7 |
| 1507 | May 15, 1998 | 1489 | 231 | RTA00000633F.f.14.1 | M00022708A:C8 |
| 1508 | May 15, 1998 | 1489 | 232 | RTA00000629F.k.11.1 | M00022106C:F4 |
| 1509 | May 15, 1998 | 1489 | 233 | RTA00000630F.b.02.1 | M00022170D:H9 |
| 1510 | May 15, 1998 | 1489 | 234 | RTA00000633F.p.04.1 | M00022902D:D3 |
| 1511 | May 15, 1998 | 1489 | 235 | RTA00000633F.n.08.1 | M00022856A:D2 |
| 1512 | May 15, 1998 | 1489 | 236 | RTA00000628F.h.06.1 | M00021897B:A6 |
| 1513 | May 15, 1998 | 1489 | 237 | RTA00000628F.d.05.1 | M00021841C:D7 |
| 1514 | May 15, 1998 | 1489 | 238 | RTA00000627F.l.22.1 | M00021624B:A3 |
| 1515 | May 15, 1998 | 1489 | 239 | RTA00000630F.f.19.1 | M00022212C:C2 |
| 1516 | May 15, 1998 | 1489 | 240 | RTA00000630F.h.17.1 | M00022220C:F8 |
| 1517 | May 15, 1998 | 1489 | 241 | RTA00000632F.i.15.1 | M00022583B:E5 |
| 1518 | May 15, 1998 | 1489 | 242 | RTA00000633F.j.15.1 | M00022745B:G2 |
| 1519 | May 15, 1998 | 1489 | 243 | RTA00000628F.k.05.1 | M00021932C:G10 |
| 1520 | May 15, 1998 | 1489 | 244 | RTA00000633F.d.04.1 | M00022685A:F11 |
| 1521 | May 15, 1998 | 1489 | 245 | RTA00000639F.h.10.1 | M00023094A:C4 |
| 1522 | May 15, 1998 | 1489 | 246 | RTA00000632F.f.11.1 | M00022535D:C4 |
| 1523 | May 15, 1998 | 1489 | 247 | RTA00000631F.p.20.1 | M00022480B:E7 |
| 1524 | May 15, 1998 | 1489 | 248 | RTA00000629F.o.17.2 | M00022150A:H6 |
| 1525 | May 15, 1998 | 1489 | 249 | RTA00000592F.l.23.1 | M00007986C:C5 |
| 1526 | May 15, 1998 | 1489 | 250 | RTA00000630F.d.10.1 | M00022189A:A1 |
| 1527 | May 15, 1998 | 1489 | 251 | RTA00000632F.j.19.1 | M00022600C:A6 |
| 1528 | May 15, 1998 | 1489 | 252 | RTA00000633F.n.10.1 | M00022856B:F4 |
| 1529 | May 15, 1998 | 1489 | 253 | RTA00000628F.h.13.1 | M00021905A:G5 |
| 1530 | May 15, 1998 | 1489 | 254 | RTA00000633F.k.05.1 | M00022763A:E10 |
| 1531 | May 15, 1998 | 1489 | 255 | RTA00000633F.i.11.1 | M00022735B:B1 |
| 1532 | May 15, 1998 | 1489 | 256 | RTA00000633F.o.20.1 | M00022900D:G3 |
| 1533 | May 15, 1998 | 1489 | 257 | RTA00000628F.b.19.1 | M00021690D:E5 |
| 1534 | May 15, 1998 | 1489 | 258 | RTA00000627F.p.14.1 | M00021667D:E3 |
| 1535 | May 15, 1998 | 1489 | 259 | RTA00000628F.n.15.1 | M00021983B:B3 |
| 1536 | May 15, 1998 | 1489 | 260 | RTA00000592F.p.22.1 | M00008074D:C1 |
| 1537 | May 15, 1998 | 1489 | 261 | RTA00000628F.m.19.1 | M00021977D:E2 |
| 1538 | May 15, 1998 | 1489 | 262 | RTA00000593F.a.05.1 | M00008078C:C6 |
| 1539 | May 15, 1998 | 1489 | 263 | RTA00000639F.g.17.1 | M00023036D:C4 |
| 1540 | May 15, 1998 | 1489 | 264 | RTA00000632F.j.15.1 | M00022599A:C3 |
| 1541 | May 15, 1998 | 1489 | 265 | RTA00000592F.l.04.1 | M00007971A:B4 |
| 1542 | May 15, 1998 | 1489 | 266 | RTA00000629F.c.07.1 | M00022054D:C5 |
| 1543 | May 15, 1998 | 1489 | 267 | RTA00000592F.l.21.1 | M00007985A:B9 |
| 1544 | May 15, 1998 | 1489 | 268 | RTA00000629F.h.15.1 | M00022085C:A7 |
| 1545 | May 15, 1998 | 1489 | 269 | RTA00000633F.n.02.1 | M00022835C:E6 |
| 1546 | May 15, 1998 | 1489 | 270 | RTA00000630F.n.24.1 | M00022278D:F10 |

TABLE 1A-continued

Priority Appln Information

| SEQ ID NO: | Filed | Dkt No. | SEQ ID NO: | Sequence Name | Clone Name |
|---|---|---|---|---|---|
| 1547 | May 15, 1998 | 1489 | 271 | RTA00000592F.k.09.1 | M00007953B:B3 |
| 1548 | May 15, 1998 | 1489 | 272 | RTA00000592F.l.10.1 | M00007974B:C11 |
| 1549 | May 15, 1998 | 1489 | 273 | RTA00000628F.k.04.1 | M00021932C:C5 |
| 1550 | May 15, 1998 | 1489 | 274 | RTA00000630F.h.24.1 | M00022226C:B6 |
| 1551 | May 15, 1998 | 1489 | 275 | RTA00000629F.i.13.1 | M00022091B:B7 |
| 1552 | May 15, 1998 | 1489 | 276 | RTA00000630F.b.01.1 | M00022170D:H7 |
| 1553 | May 15, 1998 | 1489 | 277 | RTA00000628F.g.13.1 | M00021886D:E4 |
| 1554 | May 15, 1998 | 1489 | 278 | RTA00000592F.m.13.1 | M00007995D:E6 |
| 1555 | May 15, 1998 | 1489 | 279 | RTA00000633F.h.20.1 | M00022728A:A9 |
| 1556 | May 15, 1998 | 1489 | 280 | RTA00000593F.d.08.2 | M00021860B:G6 |
| 1557 | May 15, 1998 | 1489 | 281 | RTA00000629F.f.01.1 | M00022071B:D5 |
| 1558 | May 15, 1998 | 1489 | 282 | RTA00000632F.i.11.1 | M00022582C:E12 |
| 1559 | May 15, 1998 | 1489 | 283 | RTA00000632F.j.24.1 | M00022604B:C11 |
| 1560 | May 15, 1998 | 1489 | 284 | RTA00000629F.f.03.1 | M00022071C:C9 |
| 1561 | May 15, 1998 | 1489 | 285 | RTA00000593F.b.04.1 | M00008094A:E10 |
| 1562 | May 15, 1998 | 1489 | 286 | RTA00000628F.l.12.1 | M00021952B:F11 |
| 1563 | May 15, 1998 | 1489 | 287 | RTA00000632F.j.12.1 | M00022597B:F11 |
| 1564 | May 15, 1998 | 1489 | 288 | RTA00000592F.k.23.1 | M00007964B:D10 |
| 1565 | May 15, 1998 | 1489 | 289 | RTA00000632F.g.07.1 | M00022556B:C4 |

TABLE 1B

| SEQ ID NO: | Sample Name | Overlap | Clone Name |
|---|---|---|---|
| 1566 | 803.F11.sp6:165002 | VO | M00004236D:E07 |
| 1567 | 180.B11.sp6:135937 | VO | M00001453B:F08 |
| 1568 | 1033.D01.sp6:188349 | VO | M00001455A:E09 |
| 1569 | 1164.H10.sp6:186952 | VO | M00001455A:E09 |
| 1570 | 80.E12.sp6:130267 | VNO | |
| 1571 | 121.C2.sp6:131906 | VNO | |
| 1572 | 1035.D01.sp6:188733 | VO | M00003939A:A02 |
| 1573 | 1034.G03.sp6:188579 | VNO | |
| 1574 | 020.C1.sp6:128615 | VO | M00003820C:A09 |
| 1575 | 019.B1.sp6:128411 | VO | M00003820C:A09 |
| 1576 | 803.F4.sp6:164995 | VO | M00004052C:B05 |
| 1577 | 1033.C06.sp6:188342 | VO | M00001654D:F06 |
| 1578 | 1035.H07.sp6:188787 | VO | M00004034C:F05 |
| 1579 | 396.C9.sp6:149508 | VO | M00004034C:F05 |
| 1580 | 396.D9.sp6:149520 | VO | M00004035B:F05 |
| 1581 | 1035.B08.sp6:188716 | VO | M00004035B:F05 |
| 1582 | 396.H9.sp6:149568 | VNO | |
| 1583 | 1035.D09.sp6:188741 | VO | M00004037C:D07 |
| 1584 | 1036.B05.sp6:188905 | VO | M00004115C:H04 |
| 1585 | 404.G2.sp6:162929 | VNO | |
| 1586 | 1035.D07.sp6:188739 | VO | M00004031D:G02 |
| 1587 | 1034.A05.sp6:188509 | VO | M00003829A:B08 |
| 1588 | 395.B5.sp6:149300 | VO | M00003829A:B08 |
| 1589 | 1034.F07.sp6:188571 | VO | M00003852D:D03 |
| 1590 | 1035.E04.sp6:188748 | VO | M00003982A:G03 |
| 1591 | 396.F3.sp6:149538 | VO | M00003982A:G03 |
| 1592 | 396.H3.sp6:149562 | VO | M00003982B:C10 |
| 1593 | 1035.F04.sp6:188760 | VNO | |
| 1594 | 396.D4.sp6:149515 | VO | M00003983A:D02 |
| 1595 | 1035.G04.sp6:188772 | VO | M00003983A:D02 |
| 1596 | 396.D5.sp6:149516 | VO | M00003985A:C01 |
| 1597 | 1035.B05.sp6:188713 | VO | M00003985A:C01 |
| 1598 | 1035.C06.sp6:188726 | VO | M00004028C:D01 |
| 1599 | 396.A7.sp6:149482 | VNO | |
| 1600 | 1035.E06.sp6:188750 | VO | M00004029C:B03 |
| 1601 | 801.E1.sp6:164692 | VO | M00001344D:G11 |
| 1602 | 801.F1.sp6:164704 | VO | M00001345A:A12 |
| 1603 | 801.A2.sp6:164645 | VNO | |
| 1604 | 801.B2.sp6:164657 | VNO | |
| 1605 | 801.C2.sp6:164669 | VO | M00001347A:G06 |
| 1606 | 801.D2.sp6:164681 | VO | M00001347B:H01 |
| 1607 | 801.E2.sp6:164693 | VNO | |
| 1608 | 801.F2.sp6:164705 | VNO | |
| 1609 | 801.A3.sp6:164646 | VO | M00001355B:A01 |
| 1610 | 801.B3.sp6:164658 | VO | M00001358D:D09 |
| 1611 | 801.C3.sp6:164670 | VO | M00001359A:B07 |
| 1612 | 801.D3.sp6:164682 | VO | M00001362A:C10 |
| 1613 | 801.E3.sp6:164694 | VO | M00001362B:A09 |
| 1614 | 801.G3.sp6:164718 | VO | M00001365D:D12 |
| 1615 | 801.H3.sp6:164730 | VO | M00001365D:H09 |
| 1616 | 801.A4.sp6:164647 | VNO | |
| 1617 | 801.B4.sp6:164659 | VO | M00001370A:G09 |
| 1618 | 801.C4.sp6:164671 | VO | M00001370B:B04 |
| 1619 | 801.D4.sp6:164683 | VO | M00001370B:B12 |
| 1620 | 801.E4.sp6:164695 | VNO | |
| 1621 | 801.G4.sp6:164719 | VO | M00001374D:D09 |
| 1622 | 801.D5.sp6:164684 | VO | M00001377C:B08 |
| 1623 | 801.F5.sp6:164707 | VNO | |
| 1624 | 801.G5.sp6:164720 | VNO | |
| 1625 | 801.H5.sp6:164732 | VNO | |
| 1626 | 801.A6.sp6:164649 | VO | M00001384A:C09 |
| 1627 | 801.B6.sp6:164661 | VO | M00001387A:A04 |
| 1628 | 801.D6.sp6:164685 | VO | M00001389B:B06 |
| 1629 | 801.E6.sp6:164697 | VO | M00001390A:C06 |
| 1630 | 801.F6.sp6:164709 | VO | M00001390A:H01 |
| 1631 | 801.D7.sp6:164686 | VNO | |
| 1632 | 801.E7.sp6:164698 | VO | M00001399C:E10 |
| 1633 | 1033.A01.sp6:188313 | VO | M00001399D:F09 |
| 1634 | 801.G7.sp6:164722 | VNO | |
| 1635 | 801.H7.sp6:164734 | VO | M00001401D:D04 |
| 1636 | 801.A8.sp6:164651 | VNO | |
| 1637 | 801.B8.sp6:164663 | VO | M00001402C:C07 |
| 1638 | 801.C8.sp6:164675 | VO | M00001402D:H03 |
| 1639 | 801.D8.sp6:164687 | VO | M00001403B:A01 |
| 1640 | 801.E8.sp6:164699 | VO | M00001405D:F05 |
| 1641 | 801.G8.sp6:164723 | VO | M00001406C:A11 |
| 1642 | 801.B9.sp6:164664 | VO | M00001407B:A08 |
| 1643 | 801.C9.sp6:164676 | VO | M00001407D:H11 |
| 1644 | 801.D9.sp6:164688 | VNO | |
| 1645 | 801.E9.sp6:164700 | VNO | |
| 1646 | 801.F9.sp6:164712 | VO | M00001411A:D01 |
| 1647 | 801.G9.sp6:164724 | VNO | |
| 1648 | 801.H9.sp6:164736 | VO | M00001411C:G02 |
| 1649 | 801.B10.sp6:164665 | VO | M00001412A:A11 |
| 1650 | 801.C10.sp6:164677 | VNO | |
| 1651 | 801.D10.sp6:164689 | VNO | |
| 1652 | 801.E10.sp6:164701 | VO | M00001415D:E12 |
| 1653 | 801.F10.sp6:164713 | VNO | |
| 1654 | 801.G10.sp6:164725 | VO | M00001417B:E01 |
| 1655 | 020.A6.sp6:128596 | VO | M00001417B:E01 |

TABLE 1B-continued

| SEQ ID NO: | Sample Name | Overlap | Clone Name |
|---|---|---|---|
| 1656 | 801.H10.sp6:164737 | VNO | |
| 1657 | 801.A11.sp6:164654 | VO | M00001417C:E02 |
| 1658 | 801.B11.sp6:164666 | VNO | |
| 1659 | 801.C11.sp6:164678 | VO | M00001421A:H07 |
| 1660 | 801.F11.sp6:164714 | VO | M00001423C:D06 |
| 1661 | 801.G11.sp6:164726 | VO | M00001424A:H09 |
| 1662 | 801.H11.sp6:164738 | VO | M00001425C:E10 |
| 1663 | 801.B12.sp6:164667 | VO | M00001426A:F09 |
| 1664 | 801.C12.sp6:164679 | VO | M00001426D:D09 |
| 1665 | 801.E12.sp6:164703 | VO | M00001431A:C10 |
| 1666 | 801.F12.sp6:164715 | VO | M00001431A:E05 |
| 1667 | 801.G12.sp6:164727 | VO | M00001432A:F12 |
| 1668 | 801.H12.sp6:164739 | VO | M00001432B:H08 |
| 1669 | 802.A1.sp6:164740 | VO | M00001432C:G01 |
| 1670 | 802.B1.sp6:164752 | VO | M00001433A:C07 |
| 1671 | 802.C1.sp6:164764 | VNO | |
| 1672 | 802.D1.sp6:164776 | VO | M00001434A:A01 |
| 1673 | 802.E1.sp6:164788 | VNO | |
| 1674 | 802.F1.sp6:164800 | VO | M00001435A:F03 |
| 1675 | 802.G1.sp6:164812 | VO | M00001435A:G01 |
| 1676 | 802.H1.sp6:164824 | VO | M00001435B:G10 |
| 1677 | 802.A2.sp6:164741 | VO | M00001435C:G08 |
| 1678 | 802.B2.sp6:164753 | VNO | |
| 1679 | 802.C2.sp6:164765 | VO | M00001435D:A06 |
| 1680 | 802.D2.sp6:164777 | VO | M00001436D:C10 |
| 1681 | 802.E2.sp6:164789 | VO | M00001437B:B05 |
| 1682 | 802.G2.sp6:164813 | VNO | |
| 1683 | 802.H2.sp6:164825 | VO | M00001438C:H05 |
| 1684 | 802.A3.sp6:164742 | VNO | |
| 1685 | 802.B3.sp6:164754 | VO | M00001439B:F10 |
| 1686 | 802.C3.sp6:164766 | VO | M00001439C:A01 |
| 1687 | 802.D3.sp6:164778 | VO | M00001439C:G06 |
| 1688 | 802.E3.sp6:164790 | VO | M00001441D:H05 |
| 1689 | 802.F3.sp6:164802 | VO | M00001442A:D08 |
| 1690 | 802.G3.sp6:164814 | VNO | |
| 1691 | 802.H3.sp6:164826 | VO | M00001443D:A01 |
| 1692 | 802.A4.sp6:164743 | VNO | |
| 1693 | 802.B4.sp6:164755 | VO | M00001444A:A09 |
| 1694 | 802.C4.sp6:164767 | VNO | |
| 1695 | 802.D4.sp6:164779 | VNO | |
| 1696 | 802.E4.sp6:164791 | VO | M00001446D:B10 |
| 1697 | 1033.B01.sp6:188325 | VO | M00001448A:D05 |
| 1698 | 802.F4.sp6:164803 | VO | M00001451B:H11 |
| 1699 | 802.G4.sp6:164815 | VNO | |
| 1700 | 802.H4.sp6:164827 | VO | M00001452B:H06 |
| 1701 | 802.A5.sp6:164744 | VO | M00001452D:E05 |
| 1702 | 802.C5.sp6:164768 | VO | M00001453D:F09 |
| 1703 | 1033.C01.sp6:188337 | VO | M00001455A:C03 |
| 1704 | 1033.E01.sp6:188361 | VO | M00001456C:F02 |
| 1705 | 1033.F01.sp6:188373 | VO | M00001458B:F06 |
| 1706 | 802.D5.sp6:164780 | VO | M00001463C:A01 |
| 1707 | 802.E5.sp6:164792 | VO | M00001466C:F02 |
| 1708 | 802.F5.sp6:164804 | VNO | |
| 1709 | 802.G5.sp6:164816 | VO | M00001471C:G03 |
| 1710 | 1033.G01.sp6:188385 | VO | M00001478A:B06 |
| 1711 | 1033.H01.sp6:188397 | VO | M00001487D:D11 |
| 1712 | 802.H5.sp6:164828 | VO | M00001488B:G12 |
| 1713 | 802.B6.sp6:164757 | VO | M00001489B:F08 |
| 1714 | 802.C6.sp6:164769 | VO | M00001489D:C08 |
| 1715 | 802.D6.sp6:164781 | VO | M00001490B:G04 |
| 1716 | 802.E6.sp6:164793 | VO | M00001491C:C01 |
| 1717 | 802.F6.sp6:164805 | VNO | |
| 1718 | 802.G6.sp6:164817 | VO | M00001496A:B03 |
| 1719 | 802.H6.sp6:164829 | VNO | |
| 1720 | 802.A7.sp6:164746 | VO | M00001496D:D02 |
| 1721 | 802.B7.sp6:164758 | VNO | |
| 1722 | 802.D7.sp6:164782 | VNO | |
| 1723 | 802.E7.sp6:164794 | VO | M00001500A:D09 |
| 1724 | 802.F7.sp6:164806 | VNO | |
| 1725 | 802.G7.sp6:164818 | VNO | |
| 1726 | 802.H7.sp6:164830 | VO | M00001504D:D09 |
| 1727 | 802.A8.sp6:164747 | VO | M00001505A:E09 |
| 1728 | 802.B8.sp6:164759 | VO | M00001506A:F01 |
| 1729 | 802.D8.sp6:164783 | VO | M00001517D:C03 |
| 1730 | 802.E8.sp6:164795 | VO | M00001518D:A10 |
| 1731 | 1033.A02.sp6:188314 | VO | M00001530A:D11 |
| 1732 | 802.F8.sp6:164807 | VO | M00001536B:B11 |
| 1733 | 802.G8.sp6:164819 | VO | M00001537B:C12 |
| 1734 | 1033.B02.sp6:188326 | VO | M00001539B:B01 |
| 1735 | 802.H8.sp6:164831 | VO | M00001542C:D10 |
| 1736 | 802.A9.sp6:164748 | VO | M00001542C:F06 |
| 1737 | 802.B9.sp6:164760 | VNO | |
| 1738 | 802.C9.sp6:164772 | VO | M00001543A:E04 |
| 1739 | 802.E9.sp6:164796 | VO | M00001546B:H01 |
| 1740 | 802.G9.sp6:164820 | VO | M00001551D:C12 |
| 1741 | 802.H9.sp6:164832 | VO | M00001552B:D01 |
| 1742 | 802.A10.sp6:164749 | VO | M00001553D:B06 |
| 1743 | 802.B10.sp6:164761 | VNO | |
| 1744 | 802.C10.sp6:164773 | VO | M00001556D:A11 |
| 1745 | 802.D10.sp6:164785 | VNO | |
| 1746 | 802.E10.sp6:164797 | VO | M00001557C:B08 |
| 1747 | 802.F10.sp6:164809 | VO | M00001558B:A12 |
| 1748 | 802.G10.sp6:164821 | VO | M00001560C:C01 |
| 1749 | 802.H10.sp6:164833 | VO | M00001561B:C10 |
| 1750 | 1033.C02.sp6:188338 | VO | M00001563C:D06 |
| 1751 | 1033.D02.sp6:188350 | VO | M00001564C:D04 |
| 1752 | 1033.E02.sp6:188362 | VO | M00001565A:A02 |
| 1753 | 1033.F02.sp6:188374 | VO | M00001569B:F04 |
| 1754 | 1033.G02.sp6:188386 | VO | M00001572C:E07 |
| 1755 | 1033.H02.sp6:188398 | VO | M00001575A:H02 |
| 1756 | 1033.A03.sp6:188315 | VO | M00001582B:B10 |
| 1757 | 1033.B03.sp6:188327 | VO | M00001584C:A03 |
| 1758 | 1033.E04.sp6:188364 | VO | M00001618B:F02 |
| 1759 | 1033.B08.sp6:188332 | VO | M00001687C:A06 |
| 1760 | 1033.H12.sp6:188408 | VNO | |
| 1761 | 1034.C05.sp6:188533 | VO | M00003830A:A10 |
| 1762 | 1034.F05.sp6:188569 | VO | M00003833D:D06 |
| 1763 | 1034.D06.sp6:188546 | VO | M00003839D:G06 |
| 1764 | 1034.G06.sp6:188582 | VO | M00003843A:B01 |
| 1765 | 1034.H07.sp6:188595 | VO | M00003858A:D01 |
| 1766 | 1034.A08.sp6:188512 | VO | M00003859C:B09 |
| 1767 | 1034.E08.sp6:188560 | VO | M00003868D:F07 |
| 1768 | 1034.C10.sp6:188538 | VO | M00003895D:A03 |
| 1769 | 1034.B11.sp6:188527 | VO | M00003906C:H12 |
| 1770 | 1034.G11.sp6:188587 | VNO | |
| 1771 | 1034.D12.sp6:188552 | VO | M00003918C:E07 |
| 1772 | 1035.H01.sp6:188781 | VNO | |
| 1773 | 1035.G02.sp6:188770 | VNO | |
| 1774 | 325.D3.sp6:145862 | VNO | |
| 1775 | 1035.A05.sp6:188701 | VO | |
| 1776 | 1035.F05.sp6:188761 | VNO | |
| 1777 | 803.H1.sp6:165016 | VNO | |
| 1778 | 803.F2.sp6:164993 | VNO | |
| 1779 | 1035.G06.sp6:188774 | VO | M00004030A:G12 |
| 1780 | 1035.A07.sp6:188703 | VO | M00004030B:C05 |
| 1781 | 1035.B07.sp6:188715 | VNO | |
| 1782 | 1035.D08.sp6:188740 | VO | M00004035D:C05 |
| 1783 | 1035.G08.sp6:188776 | VO | M00004036C:D01 |
| 1784 | 1035.A09.sp6:188705 | VNO | |
| 1785 | 1035.B09.sp6:188717 | VO | M00004037B:B05 |
| 1786 | 1035.G09.sp6:188777 | VO | M00004038C:D12 |
| 1787 | 803.C4.sp6:164959 | VO | M00004051C:D02 |
| 1788 | 803.A5.sp6:164936 | VNO | |
| 1789 | 774.E2.sp6:162484 | VO | M00004054D:D02 |
| 1790 | 803.D5.sp6:164972 | VNO | |
| 1791 | 803.C6.sp6:164961 | VNO | |
| 1792 | 803.D6.sp6:164973 | VNO | |
| 1793 | 1035.A12.sp6:188708 | VNO | |
| 1794 | 1035.C12.sp6:188732 | VO | M00004076D:B03 |
| 1795 | 774.E4.sp6:162500 | VO | M00004081B:C11 |
| 1796 | 1035.G12.sp6:188780 | VO | M00004081B:C11 |
| 1797 | 1036.H01.sp6:188973 | VO | M00004089A:F02 |
| 1798 | 1036.D02.sp6:188926 | VO | M00004091B:G04 |
| 1799 | 1036.G03.sp6:188963 | VO | M00004103B:C07 |
| 1800 | 1036.F04.sp6:188952 | VNO | |
| 1801 | 1036.H04.sp6:188976 | VO | M00004115A:F01 |
| 1802 | 1036.A05.sp6:188893 | VO | M00004115A:G09 |
| 1803 | 1036.B06.sp6:188906 | VNO | |
| 1804 | 803.A7.sp6:164938 | VNO | |
| 1805 | 803.E8.sp6:164987 | VNO | |
| 1806 | 803.F8.sp6:164999 | VO | M00004159D:C04 |
| 1807 | 803.A9.sp6:164940 | VO | M00004160A:D07 |
| 1808 | 1036.D06.sp6:188930 | VO | M00004178B:F06 |
| 1809 | 1036.F06.sp6:188954 | VNO | |

TABLE 1B-continued

| SEQ ID NO: | Sample Name | Overlap | Clone Name |
|---|---|---|---|
| 1810 | 1036.H06.sp6:188978 | VO | M00004184B:F11 |
| 1811 | 1036.D09.sp6:188933 | VO | M00004202B:A02 |
| 1812 | 1036.F09.sp6:188957 | VO | M00004202B:G09 |
| 1813 | 803.H10.sp6:165025 | VNO | |
| 1814 | 803.H11.sp6:165026 | VNO | |
| 1815 | 803.C12.sp6:164967 | VNO | |
| 1816 | 804.D1.sp6:165160 | VNO | |
| 1817 | 983.D01.sp6:186199 | VO | M00004247B:C11 |
| 1818 | 1036.D11.sp6:188935 | VO | M00004249C:E12 |
| 1819 | 804.B3.sp6:165138 | VNO | |
| 1820 | 983.B03.sp6:186181 | VO | M00004277D:C08 |
| 1821 | 804.F5.sp6:165188 | VNO | |
| 1822 | 983.F05.sp6:186221 | VO | M00004337D:G08 |
| 1823 | 983.G05.sp6:186230 | VO | M00004345A:H06 |
| 1824 | 804.G5.sp6:165200 | VNO | |
| 1825 | 983.A06.sp6:186174 | VO | M00004350B:F06 |
| 1826 | 804.A6.sp6:165129 | VNO | |
| 1827 | 774.D12.sp6:162563 | VO | M00004350B:F06 |
| 1828 | 804.F7.sp6:165190 | VNO | |
| 1829 | 983.F07.sp6:186223 | VO | M00004446A:G01 |
| 1830 | 992.E01.sp6:186367 | VO | M00005332A:H10 |
| 1831 | 992.G02.sp6:186392 | VNO | |
| 1832 | 992.A04.sp6:186322 | VO | M00005378C:A10 |
| 1833 | 992.D04.sp6:186358 | VO | M00005384A:A01 |
| 1834 | 992.B05.sp6:186335 | VO | M00005390B:G10 |
| 1835 | 992.H05.sp6:186407 | VO | M00005399A:D01 |
| 1836 | 992.A06.sp6:186324 | VNO | |
| 1837 | 992.B06.sp6:186336 | VO | M00005399D:B02 |
| 1838 | 020.G4.sp6:128666 | VO | M00005404C:F02 |
| 1839 | 020.G8.sp6:128670 | VO | M00005411A:C07 |
| 1840 | 992.H06.sp6:186408 | VNO | |
| 1841 | 953.F01.sp6:185185 | VO | M00005411D:A03 |
| 1842 | 992.A07.sp6:186325 | VO | M00005411D:A03 |
| 1843 | 992.D08.sp6:186362 | VO | M00005446A:G01 |
| 1844 | 992.B09.sp6:186339 | VO | M00005450B:B01 |
| 1845 | 953.A07.sp6:185131 | VO | M00005450B:B01 |
| 1846 | 953.E07.sp6:185179 | VO | M00005452C:A02 |
| 1847 | 992.E09.sp6:186375 | VO | M00005452C:A02 |
| 1848 | 992.G09.sp6:186399 | VO | M00005455A:D01 |
| 1849 | 992.H09.sp6:186411 | VO | M00005455A:G03 |
| 1850 | 992.D11.sp6:186365 | VNO | |
| 1851 | 953.H10.sp6:185218 | VO | M00005477C:D08 |
| 1852 | 992.F11.sp6:186389 | VO | M00005477C:D08 |
| 1853 | 953.D11.sp6:185171 | VO | M00005480A:H12 |
| 1854 | 992.H11.sp6:186413 | VO | M00005480C:B12 |
| 1855 | 992.A12.sp6:186330 | VO | M00005481C:A05 |
| 1856 | 953.E11.sp6:185183 | VO | M00005481C:A05 |
| 1857 | 953.C12.sp6:185160 | VO | M00005485C:A03 |
| 1858 | 992.F12.sp6:186390 | VO | M00005485C:A03 |
| 1859 | 953.E12.sp6:185184 | VO | M00005486C:B03 |
| 1860 | 993.C03.sp6:186537 | VO | M00005510B:D06 |
| 1861 | 993.D03.sp6:186549 | VO | M00005513A:D08 |
| 1862 | 993.E03.sp6:186561 | VO | M00005524C:B01 |
| 1863 | 993.G03.sp6:186585 | VO | M00005528D:H06 |
| 1864 | 993.A04.sp6:186514 | VO | M00005530B:E04 |
| 1865 | 993.B05.sp6:186527 | VO | M00005616B:D05 |
| 1866 | 993.C06.sp6:186540 | VNO | |
| 1867 | 993.B08.sp6:186530 | VO | M00005704A:B11 |
| 1868 | 993.C08.sp6:186542 | VO | M00005708D:B03 |
| 1869 | 993.D09.sp6:186555 | VO | M00005765C:C04 |
| 1870 | 993.E09.sp6:186567 | VO | M00005772A:F03 |
| 1871 | 993.F10.sp6:186580 | VO | M00006577B:H12 |
| 1872 | 993.C11.sp6:186545 | VO | M00006587A:H08 |
| 1873 | 993.D11.sp6:186557 | VNO | |
| 1874 | 993.G11.sp6:186593 | VNO | |
| 1875 | 993.H12.sp6:186606 | VO | M00006615B:F05 |
| 1876 | 626.B2.sp6:157417 | VO | M00007953B:B03 |
| 1877 | 627.E6.sp6:157649 | VO | M00007985A:B09 |
| 1878 | 633.C4.sp6:156098 | VO | M00008061A:F02 |
| 1879 | 636.F10.sp6:158241 | VO | M00022070B:C10 |
| 1880 | 641.G8.GZ42:158428 | VO | M00022109B:A11 |
| 1881 | 642.B7.sp6:156281 | VO | M00022176C:A08 |
| 1882 | 1010.F02.sp6:189986 | VNO | |
| 1883 | 1010.A09.sp6:189945 | VO | M00022828C:E04 |
| 1884 | 1033.C03.sp6:188339 | VO | M0000 1586A:F09 |
| 1885 | 1033.D03.sp6:188351 | VO | M00001588D:H08 |
| 1886 | 1033.E03.sp6:188363 | VO | M00001589C:D12 |
| 1887 | 1033.F03.sp6:188375 | VO | M00001589D:G10 |
| 1888 | 1033.G03.sp6:188387 | VO | M00001590D:A07 |
| 1889 | 802.A11.sp6:164750 | VNO | |
| 1890 | 802.B11.sp6:164762 | VO | M00001597C:B03 |
| 1891 | 1033.H03.sp6:188399 | VO | M00001598C:D10 |
| 1892 | 1033.A04.sp6:188316 | VO | M00001599A:H09 |
| 1893 | 1033.B04.sp6:188328 | VNO | |
| 1894 | 1033.C04.sp6:188340 | VO | M00001610B:A01 |
| 1895 | 1033.D04.sp6:188352 | VO | M00001614C:G04 |
| 1896 | 1033.F04.sp6:188376 | VO | M00001618C:E06 |
| 1897 | 1033.G04.sp6:188388 | VO | M00001621C:A04 |
| 1898 | 802.E11.sp6:164798 | VNO | |
| 1899 | 802.G11.sp6:164822 | VO | M00001623B:B01 |
| 1900 | 802.H11.sp6:164834 | VO | M00001623D:A09 |
| 1901 | 1033.H04.sp6:188400 | VO | M00001626B:H05 |
| 1902 | 1033.A05.sp6:188317 | VNO | |
| 1903 | 1033.B05.sp6:188329 | VO | M00001634C:E12 |
| 1904 | 1033.C05.sp6:188341 | VO | M00001639A:A04 |
| 1905 | 1033.D05.sp6:188353 | VNO | |
| 1906 | 1033.E05.sp6:188365 | VO | M00001640A:F04 |
| 1907 | 1033.F05.sp6:188377 | VO | M00001641B:G05 |
| 1908 | 802.C12.sp6:164775 | VO | M00001644D:F09 |
| 1909 | 1033.G05.sp6:188389 | VO | M00001647C:C07 |
| 1910 | 1033.H05.sp6:188401 | VO | M00001648C:F06 |
| 1911 | 1033.A06.sp6:188318 | VNO | |
| 1912 | 1033.B06.sp6:188330 | VO | M00001649D:H05 |
| 1913 | 1033.D06.sp6:188354 | VO | M00001655A:F07 |
| 1914 | 1033.E06.sp6:188366 | VO | M00001656D:F11 |
| 1915 | 1033.F06.sp6:188378 | VNO | |
| 1916 | 1033.G06.sp6:188390 | VNO | |
| 1917 | 1033.H06.sp6:188402 | VO | M00001660A:F10 |
| 1918 | 1033.A07.sp6:188319 | VO | M00001663C:C03 |
| 1919 | 1033.B07.sp6:188331 | VO | M00001669A:H11 |
| 1920 | 1033.C07.sp6:188343 | VO | M00001669B:A03 |
| 1921 | 1033.D07.sp6:188355 | VO | M00001675C:B03 |
| 1922 | 1033.E07.sp6:188367 | VO | M00001677A:A06 |
| 1923 | 1033.F07.sp6:188379 | VO | M00001677A:A12 |
| 1924 | 1033.G07.sp6:188391 | VO | M00001678D:A12 |
| 1925 | 1033.H07.sp6:188403 | VO | |
| 1926 | 1033.A08.sp6:188320 | VNO | |
| 1927 | 1033.C08.sp6:188344 | VO | M00001693D:F07 |
| 1928 | 1033.D08.sp6:188356 | VO | M00003741A:E01 |
| 1929 | 1033.E08.sp6:188368 | VO | M00003745C:E03 |
| 1930 | 1033.F08.sp6:188380 | VO | M00003746A:E01 |
| 1931 | 1033.G08.sp6:188392 | VNO | |
| 1932 | 1033.H08.sp6:188404 | VO | M00003748B:B06 |
| 1933 | 1033.A09.sp6:188321 | VO | M00003749B:C08 |
| 1934 | 1033.B09.sp6:188333 | VO | M00003749D:G07 |
| 1935 | 1033.C09.sp6:188345 | VO | M00003752A:B06 |
| 1936 | 1033.D09.sp6:188357 | VO | M00003752D:D09 |
| 1937 | 1033.E09.sp6:188369 | VO | M00003753C:B01 |
| 1938 | 1033.F09.sp6:188381 | VO | M00003754C:F01 |
| 1939 | 1033.G09.sp6:188393 | VO | M00003756C:C08 |
| 1940 | 1033.H09.sp6:188405 | VO | M00003759A:E10 |
| 1941 | 1033.A10.sp6:188322 | VO | M00003762A:D11 |
| 1942 | 1033.B10.sp6:188334 | VO | M00003763B:D03 |
| 1943 | 1033.C10.sp6:188346 | VO | M00003763D:F06 |
| 1944 | 1033.D10.sp6:188358 | VO | M00003765D:E02 |
| 1945 | 1033.E10.sp6:188370 | VO | M00003766A:G09 |
| 1946 | 1033.F10.sp6:188382 | VO | M00003766B:G04 |
| 1947 | 1033.G10.sp6:188394 | VO | M00003767C:F04 |
| 1948 | 1033.H10.sp6:188406 | VO | M00003769B:A04 |
| 1949 | 1033.A11.sp6:188323 | VO | M00003769D:G12 |
| 1950 | 1033.B11.sp6:188335 | VO | M00003770D:F08 |
| 1951 | 1033.C11.sp6:188347 | VO | M00003771A:G09 |
| 1952 | 1033.D11.sp6:188359 | VO | M00003771D:A10 |
| 1953 | 1033.E11.sp6:188371 | VO | M00003773A:C09 |
| 1954 | 1033.F11.sp6:188383 | VO | M00003773B:E09 |
| 1955 | 1033.G11.sp6:188395 | VO | M00003773B:G08 |
| 1956 | 1033.H11.sp6:188407 | VO | M00003773C:G06 |
| 1957 | 1033.A12.sp6:188324 | VO | M00003773D:C02 |
| 1958 | 802.E12.sp6:164799 | VNO | |
| 1959 | 802.F12.sp6:164811 | VNO | |
| 1960 | 802.G12.sp6:164823 | VO | M00003784C:B09 |
| 1961 | 802.H12.sp6.164835 | VO | M00003785D:E01 |
| 1962 | 803.A1.sp6:164932 | VNO | |
| 1963 | 803.B1.sp6:164944 | VNO | |

TABLE 1B-continued

| SEQ ID NO: | Sample Name | Overlap | Clone Name |
|---|---|---|---|
| 1964 | 803.C1.sp6:164956 | VNO | |
| 1965 | 1033.B12.sp6:188336 | VO | M00003789C:E03 |
| 1966 | 1033.C12.sp6:188348 | VO | M00003790B:F12 |
| 1967 | 1033.D12.sp6:188360 | VO | M00003793C:D11 |
| 1968 | 1033.F12.sp6:188384 | VO | M00003796B:C07 |
| 1969 | 1033.G12.sp6:188396 | VO | M00003796C:H03 |
| 1970 | 1034.A01.sp6:188505 | VO | M00003797D:H06 |
| 1971 | 1034.B01.sp6:188517 | VNO | |
| 1972 | 1034.C01.sp6:188529 | VO | M00003801D:F05 |
| 1973 | 1034.D01.sp6:188541 | VO | M00003805A:G05 |
| 1974 | 1034.E01.sp6:188553 | VO | M00003808C:D09 |
| 1975 | 1034.F01.sp6:188565 | VO | M00003809A:A12 |
| 1976 | 1034.G01.sp6:188577 | VO | M00003809A:H12 |
| 1977 | 1034.H01.sp6:188589 | VO | M00003809B:D08 |
| 1978 | 1034.A02.sp6:188506 | VO | M00003811B:E07 |
| 1979 | 1034.B02.sp6:188518 | VO | M00003812B:F08 |
| 1980 | 1034.C02.sp6:188530 | VO | M00003812D:E08 |
| 1981 | 1034.D02.sp6:188542 | VO | M00003813D:A06 |
| 1982 | 1034.E02.sp6:188554 | VO | M00003815C:A06 |
| 1983 | 1034.F02.sp6:188566 | VNO | |
| 1984 | 1034.G02.sp6:188578 | VNO | |
| 1985 | 1034.H02.sp6:188590 | VO | M00003818A:F09 |
| 1986 | 1034.A03.sp6:188507 | VO | M00003818B:A01 |
| 1987 | 1034.B03.sp6:188519 | VO | M00003818C:E09 |
| 1988 | 1034.C03.sp6:188531 | VNO | |
| 1989 | 1034.D03.sp6:188543 | VO | M00003819C:E04 |
| 1990 | 1034.E03.sp6:188555 | VO | M00003819D:G09 |
| 1991 | 1034.F03.sp6:188567 | VO | M00003820A:H04 |
| 1992 | 1034.H03.sp6:188591 | VO | M00003820D:E02 |
| 1993 | 1034.A04.sp6:188508 | VO | M00003821C:E04 |
| 1994 | 1034.B04.sp6:188520 | VO | M00003822A:G05 |
| 1995 | 803.E12.sp6:164991 | VNO | |
| 1996 | 020.E2.sp6:128640 | VO | M00004242C:C01 |
| 1997 | 019.F9.sp6:128467 | VO | M00006720C:C11 |
| 1998 | 019.G10.sp6:128480 | VO | M00007019A:B01 |
| 1999 | 1034.C04.sp6:188532 | VNO | |
| 2000 | 1034.D04.sp6:188544 | VO | M00003825B:A05 |
| 2001 | 1034.E04.sp6:188556 | VNO | |
| 2002 | 1034.F04.sp6:188568 | VO | M00003825C:B02 |
| 2003 | 1034.G04.sp6:188580 | VO | M00003825C:B12 |
| 2004 | 1034.B05.sp6:188521 | VO | M00003829A:E02 |
| 2005 | 1034.D05.sp6:188545 | VO | M00003832B:G03 |
| 2006 | 1034.E05.sp6:188557 | VO | M00003833B:A11 |
| 2007 | 1034.G05.sp6:188581 | VO | M00003834A:A03 |
| 2008 | 1034.A06.sp6:188510 | VO | M00003835D:H05 |
| 2009 | 1034.B06.sp6:188522 | VO | M00003837C:F05 |
| 2010 | 1034.C06.sp6:188534 | VNO | |
| 2011 | 1034.E06.sp6:188558 | VO | M00003841A:E09 |
| 2012 | 1034.F06.sp6:188570 | VO | M00003841B:D05 |
| 2013 | 1034.H06.sp6:188594 | VO | M00003844C:D04 |
| 2014 | 1034.A07.sp6:188511 | VO | M00003844C:H05 |
| 2015 | 1034.B07.sp6:188523 | VO | M00003845A:A05 |
| 2016 | 1034.C07.sp6:188535 | VO | M00003846B:H02 |
| 2017 | 1034.D07.sp6:188547 | VO | M00003846D:C12 |
| 2018 | 1034.E07.sp6:188559 | VO | M00003850B:D11 |
| 2019 | 1034.G07.sp6:188583 | VNO | |
| 2020 | 1034.B08.sp6:188524 | VO | M00003860B:A07 |
| 2021 | 803.D1.sp6:164968 | VO | M00003862C:H10 |
| 2022 | 803.E1.sp6:164980 | VO | M00003864B:A04 |
| 2023 | 803.F1.sp6:164992 | VNO | |
| 2024 | 803.G1.sp6:165004 | VO | M00003864D:G05 |
| 2025 | 1034.C08.sp6:188536 | VNO | |
| 2026 | 1034.D08.sp6:188548 | VO | M00003868D:F02 |
| 2027 | 1034.F08.sp6:188572 | VO | M00003871A:E09 |
| 2028 | 1034.G08.sp6:188584 | VNO | |
| 2029 | 1034.H08.sp6:188596 | VNO | |
| 2030 | 1034.A09.sp6:188513 | VNO | |
| 2031 | 1034.B09.sp6:188525 | VO | M00003884D:A12 |
| 2032 | 1034.C09.sp6:188537 | VNO | |
| 2033 | 1034.D09.sp6:188549 | VO | M00003887B:C03 |
| 2034 | 1034.E09.sp6:188561 | VO | M00003888B:A10 |
| 2035 | 1034.F09.sp6:188573 | VO | M00003888C:E01 |
| 2036 | 1034.G09.sp6:188585 | VO | M00003890B:H07 |
| 2037 | 1034.H09.sp6:188597 | VO | M00003890D:C03 |
| 2038 | 1034.A10.sp6:188514 | VO | M00003892D:D04 |
| 2039 | 1034.B10.sp6:188526 | VO | M00003893C:D12 |
| 2040 | 1034.D10.sp6:188550 | VO | M00003896B:F08 |
| 2041 | 1034.E10.sp6:188562 | VO | M00003896D:B01 |
| 2042 | 1034.F10.sp6:188574 | VNO | |
| 2043 | 1034.G10.sp6:188586 | VO | M00003903C:H03 |
| 2044 | 1034.H10.sp6:188598 | VO | M00003905C:B01 |
| 2045 | 1034.A11.sp6:188515 | VO | M00003905C:E10 |
| 2046 | 1034.C11.sp6:188539 | VO | M00003909D:G01 |
| 2047 | 1034.D11.sp6:188551 | VO | M00003911C:G05 |
| 2048 | 1034.E11.sp6:188563 | VO | M00003912B:G11 |
| 2049 | 1034.F11.sp6:188575 | VO | M00003912C:C11 |
| 2050 | 1034.H11.sp6:188599 | VO | M00003914C:E03 |
| 2051 | 1034.A12.sp6:188516 | VO | M00003915A:D09 |
| 2052 | 1034.B12.sp6:188528 | VNO | |
| 2053 | 1034.C12.sp6:188540 | VO | M00003915C:G01 |
| 2054 | 1034.E12.sp6:188564 | VO | M00003920B:A10 |
| 2055 | 1034.F12.sp6:188576 | VNO | |
| 2056 | 1034.G12.sp6:188588 | VO | M00003921D:C06 |
| 2057 | 1034.H12.sp6:188600 | VO | M00003923A:H07 |
| 2058 | 1035.A01.sp6:188697 | VNO | |
| 2059 | 1035.B01.sp6:188709 | VNO | |
| 2060 | 1035.C01.sp6:188721 | VO | M00003936C:F10 |
| 2061 | 1035.E01.sp6:188745 | VO | M00003948B:B03 |
| 2062 | 1035.F01.sp6:188757 | VO | M00003949B:A08 |
| 2063 | 1035.G01.sp6:188769 | VO | M00003949B:D05 |
| 2064 | 1035.A02.sp6:188698 | VO | M00003961B:A12 |
| 2065 | 1035.B02.sp6:188710 | VO | M00003961C:G02 |
| 2066 | 1035.C02.sp6:188722 | VO | M00003962B:B09 |
| 2067 | 1035.D02.sp6:188734 | VO | M00003963B:D12 |
| 2068 | 1035.E02.sp6:188746 | VO | M00003965A:F07 |
| 2069 | 1035.F02.sp6:188758 | VNO | |
| 2070 | 1035.H02.sp6:188782 | VNO | |
| 2071 | 1035.A03.sp6:188699 | VO | M00003973A:C05 |
| 2072 | 1035.B03.sp6:188711 | VO | M00003973B:H06 |
| 2073 | 1035.C03.sp6:188723 | VO | M00003974B:A04 |
| 2074 | 1035.D03.sp6:188735 | VNO | |
| 2075 | 1035.E03.sp6:188747 | VNO | |
| 2076 | 1035.F03.sp6:188759 | VNO | |
| 2077 | 1035.G03.sp6:188771 | VO | M00003976D:D12 |
| 2078 | 1035.H03.sp6:188783 | VO | M00003977C:A08 |
| 2079 | 1035.A04.sp6:188700 | VO | M00003980B:F12 |
| 2080 | 1035.B04.sp6:188712 | VO | M00003980C:A11 |
| 2081 | 1035.C04.sp6:188724 | VO | M00003980C:G10 |
| 2082 | 1035.D04.sp6:188736 | VO | M00003981C:E04 |
| 2083 | 1035.H04.sp6:188784 | VO | M00003983C:E07 |
| 2084 | 1035.C05.sp6:188725 | VNO | |
| 2085 | 1035.D05.sp6:188737 | VO | M00003987D:F06 |
| 2086 | 1035.E05.sp6:188749 | VO | M00003988B:C10 |
| 2087 | 1035.G05.sp6:188773 | VNO | |
| 2088 | 803.A2.sp6:164933 | VO | M00003992C:G01 |
| 2089 | 803.B2.sp6:164945 | VO | M00003992D:G01 |
| 2090 | 803.C2.sp6:164957 | VNO | |
| 2091 | 803.D2.sp6:164969 | VO | M00003994C:C11 |
| 2092 | 803.E2.sp6:164981 | VO | M00003996D:C04 |
| 2093 | 803.G2.sp6:165005 | VO | M00003997D:D07 |
| 2094 | 803.H2.sp6:165017 | VNO | |
| 2095 | 803.A3.sp6:164934 | VO | M00003998A:D03 |
| 2096 | 803.B3.sp6:164946 | VO | M00003998A:G12 |
| 2097 | 803.C3.sp6:164958 | VO | M00003998C:H10 |
| 2098 | 803.D3.sp6:164970 | VO | M00003999C:C12 |
| 2099 | 1035.H05.sp6:188785 | VO | M00004027A:B10 |
| 2100 | 1035.A06.sp6:188702 | VO | M00004027C:H01 |
| 2101 | 1035.B06.sp6:188714 | VO | M00004028C:B04 |
| 2102 | 1035.D06.sp6:188738 | VO | M00004029A:E01 |
| 2103 | 1035.F06.sp6:188762 | VNO | |
| 2104 | 1035.H06.sp6:188786 | VO | M00004030B:B02 |
| 2105 | 1035.C07.sp6:188727 | VO | M00004031A:G05 |
| 2106 | 1035.E07.sp6:188751 | VO | M00004032D:D03 |
| 2107 | 1035.F07.sp6:188763 | VNO | |
| 2108 | 1035.G07.sp6:188775 | VO | |
| 2109 | 1035.A08.sp6:188704 | VNO | |
| 2110 | 1035.C08.sp6:188728 | VO | M00004035B:H11 |
| 2111 | 1035.E08.sp6:188752 | VO | M00004035D:E04 |
| 2112 | 1035.F08.sp6:188764 | VO | M00004036B:F09 |
| 2113 | 1035.H08.sp6:188788 | VO | M00004037A:A07 |
| 2114 | 1035.C09.sp6:188729 | VO | M00004037C:C05 |
| 2115 | 1035.E09.sp6:188753 | VO | M00004037D:B05 |
| 2116 | 1035.F09.sp6:188765 | VO | M00004038C:C05 |
| 2117 | 1035.H09.sp6:188789 | VO | M00004039D:D03 |

TABLE 1B-continued

| SEQ ID NO: | Sample Name | Overlap | Clone Name |
|---|---|---|---|
| 2118 | 1035.A10.sp6:188706 | VO | M00004040B:B09 |
| 2119 | 1035.B10.sp6:188718 | VO | M00004040C:G12 |
| 2120 | 1035.C10.sp6:188730 | VO | M00004040D:B05 |
| 2121 | 1035.D10.sp6:188742 | VO | M00004041B:F01 |
| 2122 | 1035.E10.sp6:188754 | VO | M00004041D:E06 |
| 2123 | 1035.F10.sp6:188766 | VO | M00004043D:C10 |
| 2124 | 1035.G10.sp6:188778 | VNO | |
| 2125 | 803.E3.sp6:164982 | VO | M00004045A:B12 |
| 2126 | 803.F3.sp6:164994 | VO | M00004046A:F04 |
| 2127 | 803.G3.sp6:165006 | VNO | |
| 2128 | 803.H3.sp6:165018 | VNO | |
| 2129 | 803.A4.sp6:164935 | VNO | |
| 2130 | 803.B4.sp6:164947 | VNO | |
| 2131 | 803.D4.sp6:164971 | VNO | |
| 2132 | 803.E4.sp6:164983 | VO | M00004052C:A08 |
| 2133 | 803.G4.sp6:165007 | VO | M00004054B:G02 |
| 2134 | 803.H4.sp6:165019 | VO | M00004054D:A03 |
| 2135 | 803.B5.sp6:164948 | VO | M00004055B:F06 |
| 2136 | 803.C5.sp6:164960 | VO | M00004058B:C11 |
| 2137 | 803.E5.sp6:164984 | VO | M00004058C:E08 |
| 2138 | 803.F5.sp6:164996 | VO | M00004059A:G09 |
| 2139 | 803.G5.sp6:165008 | VO | M00004060C:A02 |
| 2140 | 803.H5.sp6:165020 | VNO | |
| 2141 | 803.A6.sp6:164937 | VO | M00004060D:A07 |
| 2142 | 803.B6.sp6:164949 | VO | M00004063C:B11 |
| 2143 | 803.E6.sp6:164985 | VNO | |
| 2144 | 1035.H10.sp6:188790 | VO | M00004068A:F02 |
| 2145 | 1035.A11.sp6:188707 | VO | M00004068B:D04 |
| 2146 | 1035.B11.sp6:188719 | VNO | |
| 2147 | 1035.C11.sp6:188731 | VO | M00004069B:B01 |
| 2148 | 1035.D11.sp6:188743 | VO | M00004069D:G02 |
| 2149 | 1035.E11.sp6:188755 | VO | M00004071A:H03 |
| 2150 | 1035.F11.sp6:188767 | VO | M00004073D:B11 |
| 2151 | 1035.G11.sp6:188779 | VNO | |
| 2152 | 1035.H11.sp6:188791 | VNO | |
| 2153 | 1035.B12.sp6:188720 | VNO | |
| 2154 | 1035.D12.sp6:188744 | VNO | |
| 2155 | 1035.E12.sp6:188756 | VNO | |
| 2156 | 1035.F12.sp6:188768 | VO | M00004078C:A08 |
| 2157 | 1035.H12.sp6:188792 | VO | M00004081A:A01 |
| 2158 | 1036.A10.sp6:188889 | VO | M00004084A:D11 |
| 2159 | 1036.B01.sp6:188901 | VO | M00004084C:G04 |
| 2160 | 1036.C01.sp6:188913 | VO | M00004085B:G06 |
| 2161 | 1036.D01.sp6:188925 | VO | M00004086A:A03 |
| 2162 | 1036.E01.sp6:188937 | VO | M00004086D:A07 |
| 2163 | 1036.F01.sp6:188949 | VO | M00004087C:F05 |
| 2164 | 1036.G01.sp6:188961 | VO | M00004088A:F12 |
| 2165 | 1036.A02.sp6:188890 | VO | M00004089A:G03 |
| 2166 | 1036.B02.sp6:188902 | VO | M00004091A:E01 |
| 2167 | 1036.C02.sp6:188914 | VO | M00004091B:C12 |
| 2168 | 1036.E02.sp6:188938 | VO | M00004091C:F04 |
| 2169 | 1036.F02.sp6:188950 | VO | M00004091D:D09 |
| 2170 | 1036.G02.sp6:188962 | VO | M00004092A:C03 |
| 2171 | 1036.H02.sp6:188974 | VO | M00004092A:D04 |
| 2172 | 1036.A03.sp6:188891 | VO | M00004093A:F03 |
| 2173 | 1036.B03.sp6:188903 | VO | M00004093D:D09 |
| 2174 | 1036.C03.sp6:188915 | VNO | |
| 2175 | 1036.D03.sp6:188927 | VO | M00004101D:A03 |
| 2176 | 1036.E03.sp6:188939 | VO | M00004102B:B04 |
| 2177 | 1036.F03.sp6:188951 | VO | M00004102C:F07 |
| 2178 | 1036.H03.sp6:188975 | VNO | |
| 2179 | 1036.A04.sp6:188892 | VNO | |
| 2180 | 1036.B04.sp6:188904 | VNO | |
| 2181 | 1036.C04.sp6:188916 | VNO | |
| 2182 | 1036.D04.sp6:188928 | VO | M00004107C:A01 |
| 2183 | 1036.E04.sp6:188940 | VNO | |
| 2184 | 1036.G04.sp6:188964 | VO | M00004114C:F02 |
| 2185 | 1036.C05.sp6:188917 | VO | M00004117B:F01 |
| 2186 | 1036.D05.sp6:188929 | VO | M00004120A:C02 |
| 2187 | 1036.E05.sp6:188941 | VO | M00004126B:G02 |
| 2188 | 1036.F05.sp6:188953 | VNO | |
| 2189 | 1036.G05.sp6:188965 | VO | M00004129A:H08 |
| 2190 | 1036.H05.sp6:188977 | VO | M00004130C:A09 |
| 2191 | 1036.A06.sp6:188894 | VO | M00004130D:E04 |
| 2192 | 1036.C06.sp6:188918 | VO | M00004133D:A01 |
| 2193 | 803.F6.sp6:164997 | VNO | |
| 2194 | 803.G6.sp6:165009 | VNO | |
| 2195 | 803.H6.sp6:165021 | VNO | |
| 2196 | 803.B7.sp6:164950 | VO | M00004143A:G12 |
| 2197 | 803.C7.sp6:164962 | VO | M00004143A:H07 |
| 2198 | 803.D7.sp6:164974 | VNO | |
| 2199 | 803.E7.sp6:164986 | VNO | |
| 2200 | 803.F7.sp6:164998 | VO | M00004145C:A03 |
| 2201 | 803.G7.sp6:165010 | VO | M00004146D:A07 |
| 2202 | 803.H7.sp6:165022 | VO | M00004147A:G03 |
| 2203 | 803.A8.sp6:164939 | VO | M00004149B:H12 |
| 2204 | 803.B8.sp6:164951 | VNO | |
| 2205 | 803.C8.sp6:164963 | VO | M00004153D:E06 |
| 2206 | 803.D8.sp6:164975 | VO | M00004154D:F11 |
| 2207 | 803.G8.sp6:165011 | VNO | |
| 2208 | 803.H8.sp6:165023 | VNO | |
| 2209 | 803.B9.sp6:164952 | VNO | |
| 2210 | 803.C9.sp6:164964 | VNO | |
| 2211 | 803.D9.sp6:164976 | VNO | |
| 2212 | 803.E9.sp6:164988 | VNO | |
| 2213 | 803.F9.sp6:165000 | VNO | |
| 2214 | 803.G9.sp6:165012 | VO | M00004166B:E10 |
| 2215 | 803.H9.sp6:165024 | VO | M00004166C:A03 |
| 2216 | 803.A10.sp6:164941 | VO | M00004166D:G07 |
| 2217 | 803.B10.sp6:164953 | VNO | |
| 2218 | 803.C10.sp6:164965 | VNO | |
| 2219 | 1036.E06.sp6:188942 | VO | M00004180B:F04 |
| 2220 | 1036.G06.sp6:188966 | VNO | |
| 2221 | 803.D10.sp6:164977 | VNO | |
| 2222 | 1036.A07.sp6:188895 | VNO | |
| 2223 | 1036.B07.sp6:188907 | VNO | |
| 2224 | 1036.C07.sp6:188919 | VNO | |
| 2225 | 1036.D07.sp6:188931 | VO | M00004188A:E10 |
| 2226 | 1036.F07.sp6:188955 | VNO | |
| 2227 | 1036.G07.sp6:188967 | VO | M00004190C:G07 |
| 2228 | 1036.H07.sp6:188979 | VO | M00004190D:A10 |
| 2229 | 1036.A08.sp6:188896 | VNO | |
| 2230 | 1036.B08.sp6:188908 | VO | M00004191B:G01 |
| 2231 | 1036.C08.sp6:188920 | VO | M00004193A:C07 |
| 2232 | 1036.D08.sp6:188932 | VO | M00004193C:H01 |
| 2233 | 803.E10.sp6:164989 | VO | M00004196C:G05 |
| 2234 | 1036.E08.sp6:188944 | VO | M00004198D:H04 |
| 2235 | 1036.F08.sp6:188956 | VO | M00004199D:C02 |
| 2236 | 1036.G08.sp6:188968 | VO | M00004200A:A09 |
| 2237 | 1036.H08.sp6:188980 | VO | M00004200A:G06 |
| 2238 | 803.F10.sp6:165001 | VNO | |
| 2239 | 1036.A09.sp6:188897 | VO | M00004200D:A07 |
| 2240 | 1036.B09.sp6:188909 | VO | M00004201D:C11 |
| 2241 | 1036.C09.sp6:188921 | VO | M00004201D:E12 |
| 2242 | 1036.E09.sp6:188945 | VNO | |
| 2243 | 1036.G09.sp6:188969 | VO | M00004204A:D04 |
| 2244 | 1036.H09.sp6:188981 | VO | M00004204A:D10 |
| 2245 | 1036.A10.sp6:188898 | VO | M00004204B:A04 |
| 2246 | 1036.B10.sp6:188910 | VNO | |
| 2247 | 1036.C10.sp6:188922 | VO | M00004210A:B09 |
| 2248 | 1036.D10.sp6:188934 | VO | M00004213A:H12 |
| 2249 | 1036.E10.sp6:188946 | VO | M00004214A:D03 |
| 2250 | 1036.F10.sp6:188958 | VO | M00004216D:E10 |
| 2251 | 1036.G10.sp6:188970 | VO | M00004217A:A05 |
| 2252 | 1036.H10.sp6:188982 | VO | M00004217A:A11 |
| 2253 | 1036.A11.sp6:188899 | VO | M00004217D:G10 |
| 2254 | 1036.B11.sp6:188911 | VO | M00004218C:G10 |
| 2255 | 1036.C11.sp6:188923 | VNO | |
| 2256 | 803.G10.sp6:165013 | VNO | |
| 2257 | 803.A11.sp6:164942 | VNO | |
| 2258 | 803.B11.sp6:164954 | VNO | |
| 2259 | 803.C11.sp6:164966 | VNO | |
| 2260 | 803.D11.sp6:164978 | VO | M00004234B:E03 |
| 2261 | 803.E11.sp6:164990 | VO | M00004234B:G06 |
| 2262 | 803.G11.sp6:165014 | VO | M00004236D:F04 |
| 2263 | 803.A12.sp6:164943 | VNO | |
| 2264 | 803.B12.sp6:164955 | VO | M00004240D:A07 |
| 2265 | 803.D12.sp6:164979 | VNO | |
| 2266 | 803.F12.sp6:165003 | VO | M00004242C:C02 |
| 2267 | 803.G12.sp6:165015 | VNO | |
| 2268 | 803.H12.sp6:165027 | VO | M00004244B:A02 |
| 2269 | 804.A1.sp6:165124 | VNO | |
| 2270 | 983.A01.sp6:186169 | VO | M00004245A:G09 |
| 2271 | 983.B01.sp6:186179 | VO | M00004245C:A03 |

TABLE 1B-continued

| SEQ ID NO: | Sample Name | Overlap | Clone Name |
|---|---|---|---|
| 2272 | 804.C1.sp6:165148 | VNO | |
| 2273 | 983.C01.sp6:186189 | VO | M00004247A:E01 |
| 2274 | 983.E01.sp6:186208 | VO | M00004248A:G08 |
| 2275 | 804.E1.sp6:165172 | VNO | |
| 2276 | 1036.E11.sp6:188947 | VNO | |
| 2277 | 1036.F11.sp6:188959 | VO | M00004252D:A07 |
| 2278 | 1036.G11.sp6:188971 | VO | M00004252D:H08 |
| 2279 | 1036.H11.sp6:188983 | VO | M00004253B:A10 |
| 2280 | 1036.A12.sp6:188900 | VO | M00004253B:F06 |
| 2281 | 1036.B12.sp6:188912 | VO | M00004253C:E10 |
| 2282 | 1036.C12.sp6:188924 | VO | M00004253D:F09 |
| 2283 | 1036.D12.sp6:188936 | VO | M00004257C:A08 |
| 2284 | 1036.E12.sp6:188948 | VO | M00004260A:B07 |
| 2285 | 1036.F12.sp6:188960 | VO | M00004260C:A12 |
| 2286 | 1036.G12.sp6:188972 | VO | M00004260C:E10 |
| 2287 | 1036.H12.sp6:188984 | VO | M00004262C:C01 |
| 2288 | 804.F1.sp6:165184 | VNO | |
| 2289 | 983.F01.sp6:186217 | VO | M00004263D:F06 |
| 2290 | 983.G01.sp6:186226 | VNO | |
| 2291 | 983.H01.sp6:186235 | VO | M00004266B:H06 |
| 2292 | 804.H1.sp6:165208 | VNO | |
| 2293 | 983.A02.sp6:186170 | VO | M00004268C:F08 |
| 2294 | 983.B02.sp6:186180 | VO | M00004268D:G07 |
| 2295 | 804.B2.sp6:165137 | VNO | |
| 2296 | 983.C02.sp6:186190 | VO | M00004269A:B11 |
| 2297 | 804.D2.sp6:165161 | VNO | |
| 2298 | 983.D02.sp6:186200 | VO | M00004269D:E08 |
| 2299 | 983.E02.sp6:186209 | VO | M00004272D:D02 |
| 2300 | 804.E2.sp6:165173 | VNO | |
| 2301 | 804.F2.sp6:165185 | VNO | |
| 2302 | 983.F02.sp6:186218 | VO | M00004273D:E11 |
| 2303 | 804.G2.sp6:165197 | VNO | |
| 2304 | 983.G02.sp6:186227 | VO | M00004276C:E12 |
| 2305 | 804.H2.sp6:165209 | VNO | |
| 2306 | 983.H02.sp6:186236 | VNO | |
| 2307 | 983.A03.sp6:186171 | VO | M00004277C:H11 |
| 2308 | 804.A3.sp6:165126 | VNO | |
| 2309 | 804.C3.sp6:165150 | VNO | |
| 2310 | 983.C03.sp6:186191 | VO | M00004279D:E02 |
| 2311 | 983.D03.sp6:186201 | VNO | |
| 2312 | 804.D3.sp6:165162 | VNO | |
| 2313 | 983.E03.sp6:186210 | VO | M00004281B:B05 |
| 2314 | 804.E3.sp6:165174 | VNO | |
| 2315 | 804.F3.sp6:165186 | VNO | |
| 2316 | 983.F03.sp6:186219 | VO | M00004283C:D03 |
| 2317 | 983.G03.sp6:186228 | VNO | |
| 2318 | 804.G3.sp6:165198 | VNO | |
| 2319 | 804.H3.sp6:165210 | VNO | |
| 2320 | 983.H03.sp6:186237 | VO | M00004285B:E01 |
| 2321 | 804.A4.sp6:165127 | VNO | |
| 2322 | 983.A04.sp6:186172 | VNO | |
| 2323 | 804.B4.sp6:165139 | VNO | |
| 2324 | 983.B04.sp6:186182 | VNO | |
| 2325 | 804.C4.sp6:165151 | VNO | |
| 2326 | 983.C04.sp6:186192 | VNO | |
| 2327 | 983.D04.sp6:186202 | VO | M00004297D:E08 |
| 2328 | 804.D4.sp6:165163 | VNO | |
| 2329 | 804.E4.sp6:165175 | VNO | |
| 2330 | 983.E04.sp6:186211 | VO | M00004298B:D04 |
| 2331 | 804.F4.sp6:165187 | VNO | |
| 2332 | 983.F04.sp6:186220 | VO | M00004308A:E06 |
| 2333 | 804.G4.sp6:165199 | VNO | |
| 2334 | 983.G04.sp6:186229 | VO | M00004324B:D09 |
| 2335 | 983.H04.sp6:186238 | VO | M00004328A:H06 |
| 2336 | 804.H4.sp6:165211 | VNO | |
| 2337 | 804.A5.sp6:165128 | VNO | |
| 2338 | 983.A05.sp6:186173 | VO | M00004329C:F11 |
| 2339 | 804.B5.sp6:165140 | VNO | |
| 2340 | 983.B05.sp6:186183 | VO | M00004331D:H08 |
| 2341 | 983.C05.sp6:186193 | VNO | |
| 2342 | 804.C5.sp6:165152 | VNO | |
| 2343 | 983.D05.sp6:186203 | VO | M00004332B:E11 |
| 2344 | 804.D5.sp6:165164 | VNO | |
| 2345 | 983.E05.sp6:186212 | VO | M00004332C:E09 |
| 2346 | 804.E5.sp6:165176 | VNO | |
| 2347 | 983.H05.sp6:186239 | VNO | |
| 2348 | 804.H5.sp6:165212 | VNO | |
| 2349 | 804.B6.sp6:165141 | VNO | |
| 2350 | 983.B06.sp6:186184 | VO | M00004383A:F02 |
| 2351 | 983.C06.sp6:186194 | VO | M00004385C:B11 |
| 2352 | 804.C6.sp6:165153 | VNO | |
| 2353 | 983.D06.sp6:186204 | VO | M00004388C:D05 |
| 2354 | 804.D6.sp6:165165 | VNO | |
| 2355 | 804.E6.sp6:165177 | VNO | |
| 2356 | 983.E06.sp6:186213 | VO | M00004389C:E01 |
| 2357 | 983.F06.sp6:186222 | VNO | |
| 2358 | 804.F6.sp6:165189 | VNO | |
| 2359 | 983.G06.sp6:186231 | VO | M00004406A:H03 |
| 2360 | 804.G6.sp6:165201 | VNO | |
| 2361 | 983.H06.sp6:186240 | VNO | |
| 2362 | 804.H6.sp6:165213 | VNO | |
| 2363 | 804.A7.sp6:165130 | VO | M00004408D:A10 |
| 2364 | 983.A07.sp6:186175 | VO | M00004408D:A10 |
| 2365 | 983.B07.sp6:186185 | VO | M00004410A:E03 |
| 2366 | 983.C07.sp6:186195 | VO | M00004412B:E03 |
| 2367 | 983.D07.sp6:186205 | VO | M00004419D:G01 |
| 2368 | 804.E7.sp6:165178 | VNO | |
| 2369 | 983.E07.sp6:186214 | VO | M00004421A:G04 |
| 2370 | 804.G7.sp6:165202 | VNO | |
| 2371 | 983.G07.sp6:186232 | VO | M00004447D:D10 |
| 2372 | 804.H7.sp6:165214 | VNO | |
| 2373 | 983.H07.sp6:186241 | VO | M00004449D:H01 |
| 2374 | 983.A08.sp6:186176 | VO | M00004460B:H09 |
| 2375 | 804.A8.sp6:165131 | VNO | |
| 2376 | 804.B8.sp6:165143 | VNO | |
| 2377 | 983.B08.sp6:186186 | VNO | |
| 2378 | 983.C08.sp6:186196 | VO | M00004465C:B10 |
| 2379 | 804.C8.sp6:165155 | VNO | |
| 2380 | 983.D08.sp6:186206 | VO | M00004465C:B12 |
| 2381 | 804.D8.sp6:165167 | VNO | |
| 2382 | 983.E08.sp6:186215 | VNO | |
| 2383 | 804.E5.sp6:165179 | VNO | |
| 2384 | 983.F08.sp6:186224 | VO | M00004467A:F09 |
| 2385 | 804.F8.sp6:165191 | VNO | |
| 2386 | 804.G8.sp6:165203 | VNO | |
| 2387 | 983.G08.sp6:186233 | VO | M00004467D:F09 |
| 2388 | 804.H8.sp6:165215 | VNO | |
| 2389 | 983.H08.sp6:186242 | VO | M00004469A:C12 |
| 2390 | 804.A9.sp6:165132 | VNO | |
| 2391 | 983.A09.sp6:186177 | VNO | |
| 2392 | 983.B09.sp6:186187 | VO | M00004491D:D07 |
| 2393 | 804.B9.sp6:165144 | VNO | |
| 2394 | 804.C9.sp6:165156 | VNO | |
| 2395 | 983.C09.sp6:186197 | VO | M00004497C:E09 |
| 2396 | 983.D09.sp6:186207 | VO | M00004498B:E01 |
| 2397 | 804.D9.sp6:165168 | VNO | |
| 2398 | 804.E9.sp6:165180 | VNO | |
| 2399 | 983.E09.sp6:186216 | VO | M00004501A:G06 |
| 2400 | 983.F09.sp6:186225 | VO | M00004506C:H10 |
| 2401 | 804.G9.sp6:165204 | VNO | |
| 2402 | 983.G09.sp6:186234 | VO | M00004508A:G12 |
| 2403 | 804.H9.sp6:165216 | VNO | |
| 2404 | 983.H09.sp6:186243 | VO | M00004508B:G02 |
| 2405 | 804.A10.sp6:165133 | VNO | |
| 2406 | 983.A10.sp6:186178 | VO | M00004509A:H02 |
| 2407 | 983.B10.sp6:186188 | VNO | |
| 2408 | 804.B10.sp6:165145 | VNO | |
| 2409 | 983.C10.sp6:186198 | VO | M00004609C:C11 |
| 2410 | 992.B01.sp6:186331 | VO | M00005294D:H02 |
| 2411 | 992.C01.sp6:186343 | VO | M00005326B:F03 |
| 2412 | 992.G01.sp6:186391 | VO | M00005342A:C04 |
| 2413 | 992.H01.sp6:186403 | VO | M00005342A:D04 |
| 2414 | 992.A02.sp6:186320 | VO | M00005342B:G10 |
| 2415 | 992.B02.sp6:186332 | VO | M00005342D:F03 |
| 2416 | 992.C02.sp6:186344 | VO | M00005349B:G01 |
| 2417 | 992.D02.sp6:186356 | VO | M00005352B:D02 |
| 2418 | 992.H02.sp6:186404 | VO | M00005354C:E02 |
| 2419 | 992.A03.sp6:186321 | VO | M00005356A:D09 |
| 2420 | 992.C03.sp6:186345 | VO | M00005359D:G07 |
| 2421 | 992.E03.sp6:186369 | VO | M00005377A:A04 |
| 2422 | 992.H03.sp6:186405 | VO | M00005378A:A08 |
| 2423 | 992.B04.sp6:186334 | VO | M00005383D:D06 |
| 2424 | 992.C04.sp6:186346 | VO | M00005383D:E07 |
| 2425 | 992.E04.sp6:186370 | VNO | |

TABLE 1B-continued

| SEQ ID NO: | Sample Name | Overlap | Clone Name |
|---|---|---|---|
| 2426 | 992.F04.sp6:186382 | VO | M00005385C:G05 |
| 2427 | 992.G04.sp6:186394 | VNO | |
| 2428 | 992.A05.sp6:186323 | VO | M00005388D:F09 |
| 2429 | 992.D05.sp6:186359 | VO | M00005393A:E11 |
| 2430 | 992.E05.sp6:186371 | VO | M00005394A:G07 |
| 2431 | 992.G05.sp6:186395 | VO | M00005397C:B03 |
| 2432 | 992.D06.sp6:186360 | VNO | |
| 2433 | 992.G06.sp6:186396 | VO | M00005409D:C02 |
| 2434 | 992.C07.sp6:186349 | VO | M00005415C:G08 |
| 2435 | 992.E07.sp6:186373 | VO | M00005417A:E10 |
| 2436 | 992.F07.sp6:186385 | VNO | |
| 2437 | 992.A08.sp6:186326 | VO | M00005442D:C05 |
| 2438 | 992.B08.sp6:186338 | VNO | |
| 2439 | 992.C08.sp6:186350 | VO | M00005444B:E11 |
| 2440 | 992.E08.sp6:186374 | VO | M00005446C:D12 |
| 2441 | 992.F08.sp6:186386 | VNO | |
| 2442 | 992.G08.sp6:186398 | VNO | |
| 2443 | 992.H08.sp6:186410 | VNO | |
| 2444 | 992.D09.sp6:186363 | VNO | |
| 2445 | 992.F09.sp6:186387 | VO | M00005454C:H12 |
| 2446 | 992.E10.sp6:186376 | VO | M00005462C:B02 |
| 2447 | 992.H10.sp6:186412 | VO | M00005468A:D08 |
| 2448 | 953.H09.sp6:185217 | VO | M00005468A:D08 |
| 2449 | 992.C11.sp6:186353 | VO | M00005469D:C11 |
| 2450 | 992.D12.sp6:186366 | VO | M00005483D:A12 |
| 2451 | 992.E12.sp6:186378 | VO | M00005484A:D09 |
| 2452 | 992.H12.sp6:186414 | VNO | |
| 2453 | 993.A01.sp6:186511 | VNO | |
| 2454 | 993.B01.sp6:186523 | VO | M00005491B:C03 |
| 2455 | 993.C01.sp6:186535 | VO | M00005493B:A12 |
| 2456 | 993.D01.sp6:186547 | VO | M00005493B:C08 |
| 2457 | 993.E01.sp6:186559 | VO | M00005493B:E01 |
| 2458 | 993.F01.sp6:186571 | VO | M00005494D:F11 |
| 2459 | 993.G01.sp6:186583 | VO | M00005496C:A01 |
| 2460 | 993.H01.sp6:186595 | VO | M00005496D:A10 |
| 2461 | 993.A02.sp6:186512 | VO | M00005497B:H07 |
| 2462 | 993.B02.sp6:186524 | VO | M00005497C:C07 |
| 2463 | 993.C02.sp6:186536 | VNO | |
| 2464 | 993.D02.sp6:186548 | VO | M00005497C:C12 |
| 2465 | 993.E02.sp6:186560 | VO | M00005497C:E03 |
| 2466 | 993.F02.sp6:186572 | VO | M00005498B:F08 |
| 2467 | 993.G02.sp6:186584 | VO | M00005498C:G05 |
| 2468 | 993.H02.sp6:186596 | VO | M00005505A:C08 |
| 2469 | 993.A03.sp6:186513 | VO | M00005508A:H01 |
| 2470 | 993.B03.sp6:186525 | VO | M00005508B:B04 |
| 2471 | 993.F03.sp6:186573 | VO | M00005528D:A10 |
| 2472 | 993.H03.sp6:186597 | VO | M00005530B:D03 |
| 2473 | 993.B04.sp6:186526 | VO | M00005534A:G06 |
| 2474 | 993.C04.sp6:186538 | VO | M00005534B:H10 |
| 2475 | 993.D04.sp6:186550 | VO | M00005539D:G07 |
| 2476 | 993.E04.sp6:186562 | VO | M00005548B:E03 |
| 2477 | 993.F04.sp6:186574 | VO | M00005550B:D09 |
| 2478 | 993.G04.sp6:186586 | VO | M00005565C:A08 |
| 2479 | 993.H04.sp6:186598 | VO | M00005571A:E11 |
| 2480 | 993.A05.sp6:186515 | VO | M00005589C:B03 |
| 2481 | 993.C05.sp6:186539 | VNO | |
| 2482 | 993.D05.sp6:186551 | VO | M00005620C:C05 |
| 2483 | 993.E05.sp6:186563 | VO | M00005621A:G10 |
| 2484 | 993.F05.sp6:186575 | VO | M00005621D:F01 |
| 2485 | 993.G05.sp6:186587 | VNO | |
| 2486 | 993.H05.sp6:186599 | VO | M00005626A:B11 |
| 2487 | 993.A06.sp6:186516 | VO | M00005631A:A11 |
| 2488 | 993.B06.sp6:186528 | VO | M00005632C:D06 |
| 2489 | 993.D06.sp6:186552 | VNO | |
| 2490 | 993.E06.sp6:186564 | VO | M00005636C:D11 |
| 2491 | 993.F06.sp6:186576 | VO | M00005637B:D12 |
| 2492 | 993.G06.sp6:186588 | VNO | |
| 2493 | 993.H06.sp6:186600 | VNO | |
| 2494 | 993.A07.sp6:186517 | VO | M00005642B:C03 |
| 2495 | 993.B07.sp6:186529 | VO | M00005645D:F08 |
| 2496 | 993.C07.sp6:186541 | VNO | |
| 2497 | 993.D07.sp6:186553 | VNO | |
| 2498 | 993.E07.sp6:186565 | VO | M00005647D:D09 |
| 2499 | 993.F07.sp6:186577 | VO | M00005655B:C02 |
| 2500 | 993.G07.sp6:186589 | VNO | |
| 2501 | 993.H07.sp6:186601 | VO | M00005703A:C08 |
| 2502 | 993.A08.sp6:186518 | VNO | |
| 2503 | 993.D08.sp6:186554 | VO | M00005710A:C08 |
| 2504 | 993.E08.sp6:186566 | VO | M00005720A:D03 |
| 2505 | 993.F08.sp6:186578 | VO | M00005720B:D09 |
| 2506 | 993.G08.sp6:186590 | VNO | |
| 2507 | 993.H08.sp6:186602 | VO | M00005722D:G03 |
| 2508 | 993.A09.sp6:186519 | VO | M00005743B:F02 |
| 2509 | 993.B09.sp6:186531 | VO | M00005762D:A01 |
| 2510 | 993.C09.sp6:186543 | VO | M00005763B:H09 |
| 2511 | 993.F09.sp6:186579 | VO | M00005783A:C05 |
| 2512 | 993.G09.sp6:186591 | VO | M00005810C:D04 |
| 2513 | 993.H09.sp6:186603 | VO | M00005812C:F10 |
| 2514 | 993.A10.sp6:186520 | VO | M00005813D:F06 |
| 2515 | 993.C10.sp6:186544 | VO | M00005818C:E08 |
| 2516 | 993.D10.sp6:186556 | VO | M00005818C:G01 |
| 2517 | 993.E10.sp6:186568 | VO | M00006576D:F11 |
| 2518 | 993.G10.sp6:186592 | VO | M00006581C:D02 |
| 2519 | 993.H10.sp6:186604 | VO | M00006581D:H08 |
| 2520 | 993.A11.sp6:186521 | VNO | |
| 2521 | 993.B11.sp6:186533 | VO | M00006582D:E05 |
| 2522 | 993.E11.sp6:186569 | VO | M00006594A:E08 |
| 2523 | 993.F11.sp6:186581 | VO | M00006594D:F09 |
| 2524 | 993.H11.sp6:186605 | VO | M00006596C:H04 |
| 2525 | 993.A12.sp6:186522 | VO | M00006601C:A07 |
| 2526 | 993.B12.sp6:186534 | VO | M00006601C:E06 |
| 2527 | 993.C12.sp6:186546 | VO | M00006601D:F04 |
| 2528 | 993.D12.sp6:186558 | VO | M00006604C:H10 |
| 2529 | 993.E12.sp6:186570 | VO | M00006607B:E03 |
| 2530 | 993.F12.sp6:186582 | VO | M00006607B:F04 |
| 2531 | 993.G12.sp6:186594 | VO | M00006609A:G10 |
| 2532 | 1010.A01.sp6:189937 | VO | M00022495C:G05 |
| 2533 | 1010.B01.sp6:189947 | VO | M00022498C:C08 |
| 2534 | 1010.C01.sp6:189957 | VO | M00022504B:E03 |
| 2535 | 1010.D01.sp6:189967 | VO | M00022505D:A12 |
| 2536 | 1010.E01.sp6:189976 | VO | M00022509D:F06 |
| 2537 | 1010.F01.sp6:189985 | VNO | |
| 2538 | 1010.G01.sp6:189994 | VO | M00022515D:C04 |
| 2539 | 1010.H01.sp6:190003 | VO | M00022527A:E05 |
| 2540 | 1010.A02.sp6:189938 | VO | M00022527D:B03 |
| 2541 | 1010.B02.sp6:189948 | VO | M00022531D:B11 |
| 2542 | 1010.C02.sp6:189958 | VO | M00022535D:B11 |
| 2543 | 1010.D02.sp6:189968 | VO | M00022535D:C04 |
| 2544 | 1010.E02.sp6:189977 | VO | M00022536B:B04 |
| 2545 | 1010.G02.sp6:189995 | VO | M00022551A:G03 |
| 2546 | 1010.H02.sp6:190004 | VO | M00022556B:C04 |
| 2547 | 1010.A03.sp6:189939 | VO | M00022556B:G02 |
| 2548 | 1010.B03.sp6:189949 | VNO | |
| 2549 | 1010.C03.sp6:189959 | VO | M00022562C:H10 |
| 2550 | 1010.D03.sp6:189969 | VNO | |
| 2551 | 1010.E03.sp6:189978 | VO | M00022578B:G05 |
| 2552 | 1010.F03.sp6:189987 | VO | M00022578C:B07 |
| 2553 | 1010.G03.sp6:189996 | VO | M00022578D:A08 |
| 2554 | 1010.H03.sp6:190005 | VO | M00022578D:F03 |
| 2555 | 1010.A04.sp6:189940 | VNO | |
| 2556 | 1010.B04.sp6:189950 | VO | M00022583B:E05 |
| 2557 | 1010.C04.sp6:189960 | VO | M00022587C:G04 |
| 2558 | 1010.D04.sp6:189970 | VO | M00022594B:H12 |
| 2559 | 1010.E04.sp6:189979 | VO | M00022597B:F11 |
| 2560 | 1010.F04.sp6:189988 | VO | M00022598A:F11 |
| 2561 | 1010.G04.sp6:189997 | VNO | |
| 2562 | 1010.H04.sp6:190006 | VO | M00022599D:E07 |
| 2563 | 1010.A05.sp6:189941 | VO | M00022600C:A06 |
| 2564 | 1010.B05.sp6:189951 | VO | M00022604B:C11 |
| 2565 | 1010.C05.sp6:189961 | VO | M00022607B:A04 |
| 2566 | 1010.D05.sp6:189971 | VO | M00022613D:C04 |
| 2567 | 1010.E05.sp6:189980 | VO | M00022651D:C06 |
| 2568 | 1010.F05.sp6:189989 | VNO | |
| 2569 | 1010.G05.sp6:189998 | VNO | |
| 2570 | 1010.H05.sp6:190007 | VO | M00022666B:E12 |
| 2571 | 1010.A06.sp6:189942 | VO | M00022666C:H11 |
| 2572 | 1010.B06.sp6:189952 | VNO | |
| 2573 | 1010.C06.sp6:189962 | VO | M00022681B:H02 |
| 2574 | 1010.D06.sp6:189972 | VO | M00022682A:F12 |
| 2575 | 1010.E06.sp6:189981 | VO | M00022685A:F11 |
| 2576 | 1010.F06.sp6:189990 | VO | M00022698C:E06 |
| 2577 | 1010.G06.sp6:189999 | VO | M00022701B:B12 |
| 2578 | 1010.H06.sp6:190008 | VO | M00022708A:C08 |
| 2579 | 1010.A07.sp6:189943 | VO | M00022708D:G10 |

TABLE 1B-continued

| SEQ ID NO: | Sample Name | Overlap | Clone Name |
|---|---|---|---|
| 2580 | 1010.B07.sp6:189953 | VO | M00022716D:D08 |
| 2581 | 1010.C07.sp6:189963 | VNO | |
| 2582 | 1010.D07.sp6:189973 | VO | M00022725C:B03 |
| 2583 | 1010.E07.sp6:189982 | VO | M00022725C:E09 |
| 2584 | 1010.F07.sp6:189991 | VO | M00022726A:A06 |
| 2585 | 1010.G07.sp6:190000 | VNO | |
| 2586 | 1010.H07.sp6:190009 | VNO | |
| 2587 | 1010.A08.sp6:189944 | VO | M00022730A:E04 |
| 2588 | 1010.B08.sp6:189954 | VNO | |
| 2589 | 1010.C08.sp6:189964 | VO | M00022735B:B01 |
| 2590 | 1010.D08.sp6:189974 | VO | M00022737A:C08 |
| 2591 | 1010.E08.sp6:189983 | VNO | |
| 2592 | 1010.F08.sp6:189992 | VO | M00022745B:G02 |
| 2593 | 1010.G08.sp6:190001 | VO | M00022763A:E10 |
| 2594 | 1010.H08.sp6:190010 | VO | M00022824C:H11 |
| 2595 | 1010.B09.sp6:189955 | VO | M00022835C:E06 |
| 2596 | 1010.C09.sp6:189965 | VO | M00022854D:H07 |
| 2597 | 1010.D09.sp6:189975 | VO | M00022856A:D02 |
| 2598 | 1010.E09.sp6:189984 | VNO | |
| 2599 | 1010.F09.sp6:189993 | VO | M00022856B:F04 |
| 2600 | 1010.G09.sp6:190002 | VO | M00022856C:B11 |
| 2601 | 1010.H09.sp6:190011 | VO | M00022893C:H11 |
| 2602 | 1010.A10.sp6:189946 | VO | M00022897A:F04 |
| 2603 | 1010.B10.sp6:189956 | VO | M00022900D:E08 |
| 2604 | 1010.C10.sp6:189966 | VO | M00022900D:G03 |
| 2605 | 019.C4.sp6:128426 | VO | M00004190A:A09 |
| 2606 | 774.C8.sp6:162530 | VO | M00004190A:A09 |
| 2607 | 1036.E07.sp6:188943 | VO | M00004190A:A09 |
| 2608 | 019.E11.sp6:128457 | VO | M00005817D:E12 |
| 2609 | 993.B10.sp6:186532 | VO | M00005817D:E12 |
| 2610 | 019.G5.sp6:128475 | VO | M00006927C:F12 |

TABLE 1C

| SEQ ID NO: | Sequence Name | THC Accession No. |
|---|---|---|
| 2611 | RTA00000587F.p.24.1.Seq | THC226834 |
| 2612 | RTA00000629F.l.02.1.Seq | THC210324 |
| 2613 | RTA00000623F.n.17.1.Seq | THC208388 |
| 2614 | RTA00000593F.i.08.2.Seq | H91190 |
| 2615 | RTA00000622F.b.03.1.Seq | AA554045 |
| 2616 | RTA00000618F.e.06.1.Seq | THC226692 |
| 2617 | RTA00000592F.o.02.1.Seq | AA099789 |
| 2618 | RTA00000618F.c.04.1.Seq | THC222808 |
| 2619 | RTA00000590F.i.01.1.Seq | THC173163 |
| 2620 | RTA00000606F.o.14.1.Seq | THC223717 |
| 2621 | RTA00000626F.d.07.1.Seq | THC234888 |
| 2622 | RTA00000587F.1.08.1.Seq | THC104384 |
| 2623 | RTA00000586F.a.13.1.Seq | THC140691 |
| 2624 | RTA00000617F.a.17.1.Seq | THC221850 |
| 2625 | RTA00000615F.b.23.1.Seq | THC205191 |
| 2626 | RTA00000632F.f.10.1.Seq | N39216 |
| 2627 | RTA00000607F.o.13.2.Seq | THC233619 |
| 2628 | RTA00000622F.c.12.1.Seq | THC118482 |
| 2629 | RTA00000625F.b.07.1.Seq | THC223154 |
| 2630 | RTA00000587F.j.01.1.Seq | H63018 |
| 2631 | RTA00000608F.i.15.1.Seq | THC216448 |
| 2632 | RTA00000592F.j.06.1.Seq | THC148215 |
| 2633 | RTA00000589F.b.14.1.Seq | THC158020 |
| 2634 | RTA00000633F.g.19.1.Seq | THC202541 |
| 2635 | RTA00000620F.o.07.1.Seq | THC155200 |
| 2636 | RTA00000586F.p.01.1.Seq | AA558590 |
| 2637 | RTA00000630F.1.10.1.Seq | THC204748 |
| 2638 | RTA00000626F.c.13.1.Seq | AA159259 |
| 2639 | RTA00000591F.m.06.1.Seq | THC227858 |
| 2640 | RTA00000630F.i.11.1.Seq | THC228806 |
| 2641 | RTA00000621F.h.08.1.Seq | THC163604 |
| 2642 | RTA00000589F.d.10.1.Seq | THC177076 |
| 2643 | RTA00000597F.p.01.1.Seq | THC210746 |
| 2644 | RTA00000619F.c.13.1.Seq | R57955 |
| 2645 | RTA00000607F.c.07.2.Seq | THC208762 |
| 2646 | RTA00000595F.b.02.1.Seq | THC233682 |
| 2647 | RTA00000631F.h.04.1.Seq | THC223281 |
| 2648 | RTA00000596F.p.18.1.Seq | THC197103 |
| 2649 | RTA00000586F.o.13.1.Seq | THC222729 |
| 2650 | RTA00000610F.p.17.1.Seq | EST19015 |
| 2651 | RTA00000596F.c.05.1.Seq | E5T72617 |
| 2652 | RTA00000632F.j.19.1.Seq | THC90741 |
| 2653 | RTA00000607F.e.23.2.Seq | AA639216 |
| 2654 | RTA00000628F.b.19.1.Seq | THC118075 |
| 2655 | RTA00000609F.d.13.1.Seq | THC195579 |
| 2656 | RTA00000621F.k.03.1.Seq | EST70278 |
| 2657 | RTA00000592F.1.04.1.Seq | THC91941 |
| 2658 | RTA00000592F.k.09.1.Seq | THC229803 |
| 2659 | RTA00000622F.e.17.1.Seq | R57425 |
| 2660 | RTA00000628F.g.13.1.Seq | THC176706 |
| 2661 | RTA00000592F.k.23.1.Seq | THC232202 |
| 2662 | RTA00000609F.m.04.2.Seq | AA507611 |
| 2663 | RTA00000626F.b.04.1.Seq | EST69420 |
| 2664 | RTA00000591F.m.01.1.Seq | H41850 |
| 2665 | RTA00000608F.n.23.1.Seq | THC214886 |
| 2666 | RTA00000583F.d.19.1.Seq | THC229251 |
| 2667 | RTA00000621F.p.15.1.Seq | THC212450 |
| 2668 | RTA00000583F.n.05.1.Seq | AA252468 |
| 2669 | RTA00000597F.f.17.1.Seq | THC219322 |
| 2670 | RTA00000606F.1.10.1.Seq | THC225232 |
| 2671 | RTA00000618F.n.14.1.Seq | THC216591 |
| 2672 | RTA00000612F.h.05.3.Seq | THC158250 |
| 2673 | RTA00000619F.a.24.1.Seq | AA437370 |
| 2674 | RTA00000617F.k.13.1.Seq | AA244445 |
| 2675 | RTA00000623F.h.07.1.Seq | THC212330 |
| 2676 | RTA00000620F.e.01.1.Seq | THC167493 |
| 2677 | RTA00000620F.h.10.1.Seq | THC232456 |
| 2678 | RTA00000589F.e.21.2.Seq | THC208239 |
| 2679 | RTA00000626F.b.22.1.Seq | THC225644 |
| 2680 | RTA00000620F.i.16.1.Seq | AA536090 |
| 2681 | RTA00000613F.c.17.1.Seq | THC92470 |
| 2682 | RTA00000621F.c.12.1.Seq | THC156244 |
| 2683 | RTA00000618F.b.17.1.Seq | THC209838 |
| 2684 | RTA00000585F.d.16.1.Seq | THC211870 |
| 2685 | RTA00000592F.a.06.1.Seq | THC233200 |
| 2686 | RTA00000583F.p.08.1.Seq | THC196844 |
| 2687 | RTA00000622F.h.21.1.Seq | EST12698 |
| 2688 | RTA00000591F.h.03.1.Seq | THC213771 |
| 2689 | RTA00000620F.g.22.1.Seq | THC224063 |
| 2690 | RTA00000588F.1.20.2.Seq | R84876 |
| 2691 | RTA00000614F.a.20.1.Seq | R84876 |
| 2692 | RTA00000611F.n.14.3.Seq | THC200742 |
| 2693 | RTA00000619F.f.23.1.Seq | THC227573 |
| 2694 | RTA00000608F.g.24.1.Seq | T93977 |
| 2695 | RTA00000595F.o.01.2.Seq | EST61392 |
| 2696 | RTA00000608F.b.23.1.Seq | THC161665 |
| 2697 | RTA00000606F.o.23.1.Seq | AA464645 |
| 2698 | RTA00000588F.i.22.3.Seq | THC162216 |
| 2699 | RTA00000610F.i.13.1.Seq | AA595068 |
| 2700 | RTA00000608F.b.15.1.Seq | EST11866 |
| 2701 | RTA00000597F.e.16.1.Seq | N88730 |
| 2702 | RTA00000610F.h.13.1.Seq | THC195895 |
| 2703 | RTA00000611F.h.21.2.Seq | EST46722 |
| 2704 | RTA00000584F.b.06.1.Seq | EST02998 |
| 2705 | RTA00000584F.b.06.2.Seq | EST02998 |
| 2706 | RTA00000608F.j.05.1.Seq | EST60433 |
| 2707 | RTA00000588F.b.03.1.Seq | THC164651 |

TABLE 2A

Nearest Neighbor (BlastN vs. Genbank)

| SEQ ID | ACC'N | DESCRIP. | P VALUE |
|---|---|---|---|
| 571 | L17043 | *Homo sapiens* pregnancy-specific beta-1-glycoprotein-11 gene. | 1.00E-12 |
| 578 | M18864 | Rat bone protein I (BP-I) mRNA, partial cds. | 7.00E-30 |
| 609 | L13838 | Human genomic sequence from chromosome 13, clone ch13lambdacDNA17–18. | 4.00E-36 |
| 618 | U09646 | Human carnitine palmitoyltransferase II precursor | 1.00E-34 |
| 627 | U72621 | Human LOT1 mRNA, complete cds | 1.00E-43 |
| 629 | M20910 | Human 7S L gene, complete. | 1.00E-35 |
| 636 | Z48950 | *H.sapiens* hH3.3B gene for histone H3.3 | 4.00E-36 |
| 639 | X00247 | Human translocated c-myc gene in Raji Burkitt lymphoma cells | 3.00E-44 |
| 643 | D80007 | Human mRNA for KIAA0185 gene, partial cds | 7.00E-52 |
| 646 | U14967 | Human ribosomal protein L21 mRNA, complete cds. | 2.00E-42 |
| 649 | M13934 | Human ribosomal protein S14 gene, complete cds. | 4.00E-45 |
| 652 | NM_003902.1 | *Homo sapiens* far upstream element binding protein (FUBP) mRNA > :: gb|U05040|HSU05040 Human FUSE binding protein mRNA, complete cds. | 1.00E-54 |
| 657 | L41142 | *Homo sapiens* signal transducer and activator of transcription (STAT5) mRNA, complete cds. | 2.00E-62 |
| 665 | Z12112 | pWE15A cosmid vector DNA | 2.00E-52 |
| 667 | Z54386 | *H.sapiens* CpG island DNA genomic Mse1 fragment, clone 10g3, forward read cpg10g3.ft1a | 7.00E-48 |
| 668 | X80333 | *M.musculus* rab18 mRNA | 2.00E-52 |
| 669 | X52126 | Human alternatively spliced c-myb mRNA | 1.00E-64 |
| 671 | L26247 | *Homo sapiens* suiliso1 mRNA, complete cds. | 3.00E-54 |
| 676 | NM_001736.1 | *Homo sapiens* complement component 5 receptor 1 C5a anaphylatoxin receptor mRNA, complete cds. | 4.00E-56 |
| 677 | Z50798 | *G.gallus* mRNA for p52 | 4.00E-55 |
| 679 | AB002368 | Human mRNA for KIAA0370 gene, partial cds | 2.00E-58 |
| 681 | M26697 | Human nucleolar protein (B23) mRNA, complete cds. | 4.00E-48 |
| 683 | D42087 | Human mRNA for KIAA0118 gene, partial cds | 4.00E-56 |
| 693 | D50734 | Rat mRNA of antizyme inhibitor, complete cds | 2.00E-50 |
| 697 | X02344 | *Homo sapiens* beta 2 gene | 1.00E-67 |
| 698 | NM_001067.1 | *Homo sapiens* topoisomerase (DNA) II alpha topoisomerase II (top2) mRNA, complete cds. | 7.00E-63 |
| 701 | U36309 | *Gallus gallus* rhoGap protein mRNA, complete cds | 3.00E-62 |
| 703 | NM_002842.1 | *Homo sapiens* protein tyrosine phosphatase, receptor type, H (PTPRH) mRNA > :: dbj|D15049|HUMSAP1C Human mRNA for protein tyrosine phosphatase | 2.00E-81 |
| 707 | U47322 | Cloning vector DNA, complete sequence. | 1.00E-63 |
| 714 | NM_001190.1 | *Homo sapiens* branched chain aminotransferase 2. mitochondrial (BCAT2) mRNA > :: gb|U68418|HSU68418 Human branched chain aminotransferase precursor (BCATm) mRNA, nuclear gene encoding mitochondrial protein, complete cds | 4.00E-67 |
| 718 | S62077 | HP1Hs alpha = 25 kda chromosomal autoantigen [human, mRNA, 876 nt] | 5.00E-68 |
| 719 | U34991 | Human endogenous retrovirus clone c18.4, HERV-H/HERV-E hybrid multiply spliced protease/integrase mRNA, complete cds, and envelope protein mRNA, partial cds | 2.00E-61 |
| 722 | U18671 | Human Stat2 gene, complete cds. | 4.00E-77 |
| 723 | L18964 | Human protein kinase C iota isoform (PRKCI) mRNA, complete cds. | 4.00E-68 |
| 724 | D29956 | Human mRNA for KIAA0055 gene, complete cds | 6.00E-70 |
| 725 | M77140 | *H.sapiens* pro-galanin mRNA, 3' end. | 2.00E-72 |
| 728 | U51432 | *Homo sapiens* nuclear protein Skip mRNA, complete cds | 1.00E-75 |
| 729 | M84334 | *Macacca mulatta* hnRNP A1-gamma isoform mRNA, complete cds. | 5.00E-50 |
| 730 | NM_002592.1 | *Homo sapiens* proliferating cell nuclear antigen (PCNA) mRNA >:: gb|M15796|HUMCYL Human cyclin protein gene, complete cds. | 1.00E-74 |
| 731 | M88458 | Human ELP-1 mRNA sequence. | 4.00E-76 |
| 732 | U44940 | *Mus musculus* quaking type I (QKI) mRNA, complete cds | 2.00E-69 |
| 733 | D17577 | Mouse mRNA for kinesin-like protein (Kif1b), complete cds | 2.00E-71 |
| 734 | U18920 | Human chromosome 17q12-21 mRNA, clone pOV-3, partial cds. | 2.00E-72 |
| 736 | M21188 | Human insulin-degrading enzyme (IDE) mRNA, complete cds. | 7.00E-82 |
| 737 | U49058 | *Rattus norvegicus* CTD-binding SR-like protein rA4 mRNA, partial cds | 1.00E-67 |
| 739 | D10630 | *Mus musculus* mRNA for zinc finger protein, complete cds, clone:CTfin51 | 4.00E-76 |
| 740 | U29156 | *Mus musculus* eps15R mRNA, complete cds. | 3.00E-84 |
| 741 | Y08135 | *M.musculus* mRNA for ASM-like phosphodiesterase 3a | 1.00E-86 |
| 742 | Y90567 | *Gallus gallus* glutamine rich protein mRNA, partial cds | 5.00E-58 |
| 743 | U58280 | *Mus musculus* second largest subunit of RNA polymerase I (RPA2) mRNA, complete cds | 4.00E-77 |
| 744 | S79539 | Pat-12 = Pat-12 product [mice, embryonic stem ES cells, mRNA, 2781 nt] | 9.00E-84 |

TABLE 2A-continued

Nearest Neighbor (BlastN vs. Genbank)

| SEQ ID | ACC'N | DESCRIP. | P VALUE |
|---|---|---|---|
| 745 | D30666 | Rat mRNA for brain acyl-CoA synthetase II, complete cds | 2.00E−89 |
| 746 | U29156 | *Mus musculus* eps15R mRNA, complete cds. | 2.00E−92 |
| 748 | U36909 | *Bos taurus* Rho-associated kinase mRNA, complete cds | e−104 |
| 749 | L36315 | *Mus musculus* (clone pMLZ-1) zinc finger protein | e−105 |
| 750 | X80169 | *M.musculus* mRNA for 200 kD protein | e−106 |
| 751 | X83577 | *M.musculus* mRNA for K-glypican | e−107 |
| 1060 | Z95437 | Human DNA sequence from cosmid A1 on chromosome 6 contains ESTs. HERV like retroviral sequence | 8.00E−21 |
| 1112 | X69907 | *H.sapiens* gene for mitochondrial ATP synthase c subunit (P1 form) | 6.00E−07 |
| 1125 | M19390 | Bovine interstitial retinol binding protein | 8.00E−31 |
| 1156 | U19247 | *Homo sapiens* interferon-gamma receptor alpha chain gene, exon 7 and complete cds | 7.00E−41 |
| 1170 | U20239 | *Mus musculus* fibrosin mRNA, partial cds | 5.00E−38 |
| 1171 | D26361 | Human mRNA for KIAA0042 gene, complete cds | 2.00E−41 |
| 1195 | NM_000694.1 | *Homo sapiens* aldehyde dehydrogenase 7 (ALDH7) mRNA > :: gb|U10868|HSU10868 Human aldehyde dehydrogenase ALDH7 mRNA, complete cds. | 1.00E−37 |
| 1196 | U84404 | Human E6-associated protein E6-AP/ubiquitin-protein ligase (UBE3A) mRNA, alternatively spliced, complete cds | 1.00E−46 |
| 1203 | U51714 | Human GPI protein p137 mRNA, partial sequence, 3'-UTR. | 9.00E−53 |
| 1204 | U58884 | *Mus musculus* SH3-containing protein SH3P7 mRNA, complete cds. similar to Human Drebrin | 2.00E−49 |
| 1210 | X79067 | *H.sapiens* ERF-1 mRNA 3' end | 2.00E−72 |
| 1212 | U00946 | Human clone A9A2BRB5 (CAC)n/(GTG)n repeat-containing mRNA | 3.00E−54 |
| 1217 | D11078 | *Homo sapiens* RGH2 gene, retrovirus-like element | 6.00E−49 |
| 1219 | U05989 | *Rattus norvegicus* clone par-4 induced by effectors of apoptosis mRNA, complete cds. | 3.00E−64 |
| 1220 | U13185 | Cloning vector pbetagal-Enhancer, complete sequence. | 3.00E−52 |
| 1222 | D87443 | Human mRNA for KIAA0254 gene, complete cds | 8.00E−63 |
| 1225 | U19867 | Cloning vector pSPL3, exon splicing vector, complete sequence, HIV envelope protein gp160 and beta-lactamase, complete cds. | 7.00E−72 |
| 1227 | U04817 | Human protein kinase PITSLRE alpha 2–3 mRNA, complete cds. | 4.00E−57 |
| 1230 | U03687 | *Photinus pyralis* modified luciferase gene, complete cds, and pUC18 derived vector. | 3.00E−62 |
| 1231 | U27196 | *Gallus gallus* zinc finger protein (Fzf-1) mRNA, complete cds. | 1.00E−66 |
| 1235 | X53586 | Human mRNA for integrin alpha 6 | 2.00E−71 |
| 1236 | J05016 | Human (clone pA3) protein disulfide isomerase related protein (ERp72) mRNA, complete cds. | 3.00E−67 |
| 1237 | M86752 | Human transformation-sensitive protein (IEF SSP 3521) mRNA, complete cds. | 1.00E−66 |
| 1239 | L19437 | Human transaldolase mRNA containing transposable element, complete cds | 5.00E−70 |
| 1241 | X90857 | *H.sapiens* mRNA for −14 gene, containing globin regulatory element | 1.00E−74 |
| 1242 | NM_003980.1 | *Homo sapiens* microtubule associated protein 7 mRNA | 9.00E−76 |
| 1245 | U17901 | *Rattus norvegicus* phospholipase A-2-activating protein (plap) mRNA, complete cds. | 3.00E−75 |
| 1246 | S80632 | threonine, tyrosine phosphatase [human, brain, mRNA Partial, 1236 nt] | 2.00E−69 |
| 1247 | M76541 | Human DNA-binding protein (NF-E1) mRNA, complete cds. | 2.00E−80 |
| 1248 | S55305 | 14-3-3 protein gamma subtype = putative protein kinase C regulatory protein [rats, brain, mRNA, 3410 nt] > :: dbj|D17447|D17447 *Rattus norvegicus* mRNA for 14-3-3 protein gamma-subtype, complete cds | 7.00E−93 |
| 1249 | NM_002350.1 | *Homo sapiens* v-yes-1 Yamaguchi sarcoma viral related oncogene homolog (LYN) mRNA > :: gb|M16038|HUMLYN Human lyn mRNA encoding a tyrosine kinase. | 3.00E−86 |
| 1250 | Y10725 | *M.musculus* mRNA for protein kinase KIS | 4.00E−68 |
| 1251 | U89931 | Cloning vector pTRE, complete sequence | 3.00E−65 |
| 1252 | Z46386 | Bovine herpesvirus type 4 DNA for nonconserved region F (DN599 like strain) | 3.00E−73 |
| 1253 | L77599 | *Homo sapiens* (clone SEL214) 17q YAC (303G8) RNA. | 2.00E−69 |
| 1255 | Y10746 | *H.sapiens* mRNA for protein containing MBD 1 | 2.00E−79 |
| 1256 | L77599 | *Homo sapiens* (clone SEL214) 17q YAC (303G8) RNA. | 2.00E−71 |
| 1257 | Z57619 | *H.sapiens* CpG island DNA genomic Mse1 fragment, clone 187a6, forward read cpg187a6.ft1b | 7.00E−72 |
| 1258 | U48807 | Human MAP kinase phosphatase (MKP-2) mRNA, complete cds | 3.00E−76 |
| 1260 | M27444 | *Bos taurus* (clone pTKD7) dopamine and cyclic AMP-regulated neuronal phosphoprotein (DARPP-32) mRNA, complete cds. | 4.00E−76 |
| 1261 | U37150 | *Bos taurus* peptide methionine sulfoxide reductase (msrA) mRNA, complete cds | 5.00E−78 |

TABLE 2A-continued

Nearest Neighbor (BlastN vs. Genbank)

| SEQ ID | ACC'N | DESCRIP. | P VALUE |
|---|---|---|---|
| 1262 | U02435 | Cloning vector pSVbeta, complete sequence | 1.00E−77 |
| 1263 | U09662 | Cloning vector pSEAP-Enhancer, complete sequence | 4.00E−79 |
| 1264 | M99566 | sCos cloning vector SfiI containing bacteriophage promoters and flanking restriction sites in sCos vectors. | 1.00E−79 |
| 1266 | Z12112 | pWE15A cosmid vector DNA | 4.00E−80 |
| 1267 | U55387 | *Cricetulus griseus* SL15 mRNA, complete cds | 2.00E−82 |
| 1269 | L14684 | *Rattus norvegicus* nuclear-encoded mitochondrial elongation factor G mRNA, complete cds. | 2.00E−91 |
| 1270 | U49057 | *Rattus norvegicus* CTD-binding SR-like protein rA9 mRNA, complete cds | 7.00E−93 |
| 1271 | U57368 | *Mus musculus* EGF repeat transmembrane protein mRNA, complete cds. | 4.00E−97 |
| 1272 | AF000938 | *Mus musculus* RNA polymerase I largest subunit | 8.00E−94 |
| 1274 | X80169 | *M.musculus* mRNA for 200 kD protein | e−102 |
| 1275 | U09874 | *Mus musculus* SKD3 mRNA, complete cds. | e−105 |
| 1276 | D78020 | Rat mRNA for NFI-A4, partial cds | e−108 |
| 1515 | Z73360 | Human DNA sequence from cosmid 92M18, BRCA2 gene region chromosome 13q12-13 | 9.00E−22 |
| 1522 | X62078 | *H.sapiens* mRNA for GM2 activator protein | 7.00E−72 |
| 1523 | X85750 | *H.sapiens* mRNA for transcript associated with monocyte to macrophage differentiation | 2.00E−50 |
| 1525 | X03473 | Human gene for histone H1(0) | 1.00E−67 |
| 1535 | X64411 | *R.norvegicus* mRNA for 100 kDa protein | 1.00E−54 |
| 1538 | X13345 | Human gene for plasminogen activator inhibitor 1 | 2.00E−59 |
| 1542 | D86971 | Human mRNA for KIAA0217 gene, partial cds | 7.00E−83 |
| 1543 | NM_001859.1 | *Homo sapiens* solute carrier family 31 gb|U83460|HSU83460 Human high-affinity copper uptake protein (hCTR1) mRNA, complete cds | 7.00E−72 |
| 1544 | X68194 | *H.sapiens* h-Sp1 mRNA | 5.00E−57 |
| 1545 | AB002326 | Human mRNA for KIAA0328 gene, partial cds | 3.00E−74 |
| 1548 | D31762 | Human mRNA for KIAA0057 gene, complete cds | 3.00E−85 |
| 1550 | X58472 | Mouse KIN17 mRNA for kin17 protein | 2.00E−57 |
| 1551 | U13185 | Cloning vector pbetagal-Enhancer, complete sequence. | 2.00E−79 |
| 1552 | U55939 | Expression vector pVP-Nco, complete sequence. | 1.00E−76 |
| 1553 | D87671 | *Rattus norvegicus* mRNA for TIP120, complete cds | 1.00E−87 |
| 1554 | U25691 | *Mus musculus* lymphocyte specific helicase mRNA, complete cds | 4.00E−86 |
| 1555 | U55939 | Expression vector pVP-Nco, complete sequence. | 5.00E−79 |
| 1556 | Z12112 | pWE15A cosmid vector DNA | 2.00E−79 |
| 1557 | U13185 | Cloning vector pbetagal-Enhancer, complete sequence. | 2.00E−79 |
| 1558 | U13185 | Cloning vector pbetagal-Enhancer, complete sequence. | 6.00E−80 |
| 1559 | Z12112 | pWE15A cosmid vector DNA | 6.00E−80 |
| 1560 | U09661 | Cloning vector pSEAP-Control, complete sequence | 6.00E−80 |
| 1561 | U36909 | *Bos taurus* Rho-associated kinase mRNA, complete cds | 2.00E−90 |
| 1562 | L36610 | *Mus musculus* protein synthesis initiation factor 4A (eIF-4A) gene, exons 5, 6, 7, 8, and 9. | 2.00E−71 |
| 1563 | S79463 | M-Sema F = a factor in neural network development | 1.00E−85 |
| 1564 | U35312 | *Mus musculus* nuclear receptor co-repressor mRNA, complete cds | 1.00E−98 |
| 1571 | L32977 | *Homo sapiens* (clone f17252) ubiquinol cytochrome c reductase Rieske iron-sulphur protein (UQCRFS1) gene, exon 2 | 0 |
| 1576 | S78454 | *Mus musculus* metal response element DNA-binding protein M96 mRNA, complete cds | 0 |
| 1586 | M88458 | Human ELP-1 mRNA sequence. | 0 |
| 1622 | S77512 | LAMB2 = laminin beta 2 chain [human, placenta, mRNA, 5642 nt] | e−131 |
| 1624 | X53305 | *H.sapiens* mRNA for statlimin | 0 |
| 1625 | J03591 | Human ADP/ATP translocase mRNA, 3' end, clone pHAT3. | 0 |
| 1630 | L18964 | Human protein kinase C iota isoform (PRKCI) mRNA, complete cds. | 2E−67 |
| 1640 | D29956 | Human mRNA for KIAA0055 gene, complete cds | 0 |
| 1649 | M26697 | Human nucleolar protein (B23) mRNA, complete cds. | e−149 |
| 1669 | U47322 | Cloning vector DNA, complete sequence. | 4E−65 |
| 1689 | NM_002079.1 | *Homo sapiens* glutamic-oxaloacetic transaminase 1, soluble (aspartate aminotransferase 1) aspartate aminotransferase mRNA, complete cds. | 0 |
| 1693 | U55939 | Expression vector pVP-Nco, complete sequence. | 2E−70 |
| 1694 | D80007 | Human mRNA for KIAA0185 gene, partial cds | 0 |
| 1695 | NM_001904.1 | *Homo sapiens* catenin (cadherin-associated protein), beta 1 (88kD) (CTNNB1) mRNA > :: emb|X87838|HSRNABECA *H.sapiens* mRNA for beta-catenin | e−108 |
| 1701 | U19867 | Cloning vector pSPL3, exon splicing vector, complete sequence, HIV envelope protein gp160 and beta-lactamase, complete cds. | 1E−44 |
| 1702 | M31061 | Human ornithine decarboxylase gene, complete cds. | 0 |

TABLE 2A-continued

Nearest Neighbor (BlastN vs. Genbank)

| SEQ ID | ACC'N | DESCRIP. | P VALUE |
|---|---|---|---|
| 1721 | Z96177 | *H.sapiens* telomeric DNA sequence, clone 10QTEL040, read 10QTELOO040.seq | 2E−70 |
| 1722 | NM_001904.1 | *Homo sapiens* catenin (cadherin-associated protein), beta 1 (88 kD) (CTNNB1) mRNA > :: emb|X87838|HSRNABECA *H.sapiens* mRNA for beta-catenin | e−176 |
| 1758 | X83577 | *M.musculus* mRNA for K-glypican | 0 |
| 1761 | S79539 | Pat-12 = Pat-12 product [mice, embryonic stem ES cells, mRNA, 2781 nt] | e−176 |
| 1773 | L38951 | *Homo sapiens* importin beta subunit mRNA, complete cds | 1E−78 |
| 1776 | NM_003902.1 | *Homo sapiens* far upstream element binding protein (FUBP) mRNA > :: gb|U05040|HSU05040 Human FUSE binding protein mRNA, complete cds. | 0 |
| 1791 | L08783 | BlueScribe M13 Plus cloning vector. | 0 |
| 1809 | U86751 | Human nucleolar fibrillar center protein (ASE-1) mRNA, complete cds | 8E−95 |
| 1817 | M21188 | Human insulin-degrading enzyme (IDE) mRNA, complete cds. | e−134 |
| 1831 | NM_001614.1 | *Homo sapiens* actin, gamma 1 (ACTG1) mRNA > :: emb|X04098|HSACTCGR Human mRNA for cytoskeletal gamma-actin | 0.00E+00 |
| 1836 | U12404 | Human Csa-19 mRNA, complete cds. | 0 |
| 1837 | X79236 | *H.sapiens* rps26 gene | e−145 |
| 1838 | NM_003313.1 | *Homo sapiens* tissue specific transplantation antigen P35B (TSTA3) mRNA > :: gb|U58766|HSU58766 Human FX protein mRNA, complete cds | 0 |
| 1839 | M27436 | Human tissue factor gene, complete cds, with a Alu repetitive sequence in the 3' untranslated region. > :: gb|I05724| Sequence 12 from Patent EP 0278776 | e−121 |
| 1849 | X79067 | *H.sapiens* ERF-1 mRNA 3' end | 0 |
| 1850 | NM_003017 | *Homo sapiens* splicing factor, arginine/serine-rich 3 (SFRS3) mRNA > :: gb|L10838|HUMSRP20 *Homo sapiens* SR protein family, pre-mRNA splicing factor (SRp20) mRNA, complete cds. | e−135 |
| 1857 | U48807 | Human MAP kinase phosphatase (MKP-2) mRNA, complete cds | 0.00E+00 |
| 1858 | U48807 | Human MAP kinase phosphatase (MKP-2) mRNA, complete cds | 0.00E+00 |
| 1873 | U04817 | Human protein kinase PITSLRE alpha 2–3 mRNA, complete cds. | 8.00E−53 |
| 1876 | U18297 | Human MST1 (MST1) mRNA, complete cds. | 0.00E+00 |
| 1877 | NM_001859.1 | *Homo sapiens* solute carrier family 31 gb|U83460|HSU83460 Human high-affinity copper uptake protein (hCTR1) mRNA, complete cds | 0 |
| 1889 | X70272 | single stranded replicative centromeric *Saccharomyces cerevisiae*/*E. coli* shuttle vector | 3.00E−76 |
| 1897 | L26050 | Human mitochondrial 2,4-dienoyl-CoA reductase mRNA, complete cds. | 0.00E+00 |
| 1899 | X06747 | Human hnRNP core protein A1 | e−157 |
| 1901 | M64571 | Human microtubule-associated protein 4 mRNA, complete cds. | 0.00E+00 |
| 1908 | X65322.1 | Cloning vector pCAT-Basic | 9.00E−53 |
| 1913 | NM_002654.1 | *Homo sapiens* pyruvate kinase, muscle (PKM2) mRNA > :: gb|M23725|HUMPKM2L Human M2-type pyruvate kinase mRNA, complete cds. | e−159 |
| 1916 | U49352 | Human liver 2,4-dienoyl-CoA reductase mRNA, complete cds | 2.00E−71 |
| 1926 | D31889 | Human mRNA for KIAA0072 gene, partial cds > :: gb|G27027|G27027 human STS SHGC-31585. | e−167 |
| 1941 | U43944 | Human breast cancer cytosolic NADP(+)-dependent malic enzyme mRNA, partial cds | 1.00E−89 |
| 1971 | U83659 | Human multidrug resistance-associated protein homolog (MRP3) mRNA, partial cds | 3.00E−85 |
| 1996 | M33519 | Human HLA-B-associated transcript 3 (BAT3) mRNA, complete cds. | 3.00E−84 |
| 1997 | U55387 | *Cricetulus griseus* SL15 mRNA, complete cds | e−150 |
| 2018 | L36315 | *Mus musculus* (clone pMLZ-1) zinc finger protein | e−162 |
| 2025 | NM_003902.1 | *Homo sapiens* far upstream element binding protein (FUBP) mRNA > :: gb|U05040|HSU05040 Human FUSE binding protein mRNA, complete cds. | e−175 |
| 2032 | X56932 | *H.sapiens* mRNA for 23 kD highly basic protein | 0.00E+00 |
| 2039 | X98654 | *H.sapiens* mRNA for DRES9 protein | 9.00E−97 |
| 2050 | S62077 | HP1Hs alpha = 25 kda chromosomal autoantigen [human, mRNA, 876 nt] | 4.00E−68 |
| 2057 | M23619 | Human HMG-I protein isoform mRNA (HMGI gene), clone 6A. | e−117 |
| 2077 | NM_003217.1 | *Homo sapiens* testis enhanced gene transcript | 4E−99 |
| 2092 | U18671 | Human Stat2 gene, complete cds. | 0.00E+00 |
| 2096 | D43636 | Human mRNA for KIAA0096 gene, partial cds | 0 |

TABLE 2A-continued

Nearest Neighbor (BlastN vs. Genbank)

| SEQ ID | ACC'N | DESCRIP. | P VALUE |
|---|---|---|---|
| 2098 | NM_002734.1 | *Homo sapiens* protein kinase, cAMP-dependent, regulatory, type I, alpha (tissue specific extinguisher 1) (PRKAR1A) mRNA > :: gb|M33336|HUMCAMPPK Human cAMP-dependent protein kinase type 1-alpha subunit | 0 |
| 2099 | U72621 | Human LOT1 mRNA, complete cds | 0.00E+00 |
| 2112 | NM_003902.1 | *Homo sapiens* far upstream element binding protein (FUBP) mRNA > :: gb|U05040|HSU05040 Human FUSE binding protein mRNA, complete cds. | 0.00E+00 |
| 2118 | L41142 | *Homo sapiens* signal transducer and activator of transcription (STAT5) mRNA, complete cds. | 0.00E+00 |
| 2119 | Z48950 | *H.sapiens* hH3.3B gene for histone H3.3 | 0.00E+00 |
| 2153 | L09260 | Human (chromosome 3p25) membrane protein mRNA. | e-100 |
| 2158 | X65304.1 | Cloning vector pGEM-3Z | e-173 |
| 2163 | NM_003358.1 | *Homo sapiens* UDP-glucose ceramide glucosyltransferase (UGCG) mRNA > :: dbj|D50840|HUMCGA *Homo sapiens* mRNA for ceramide glucosyltransferase, complete cds > :: dbj|E12454|E12454 cDNA encoding human ceramide glucosyltransferase | e-141 |
| 2179 | M95605 | *Bos taurus* S-adenosylmethionine decarboxylase | e-175 |
| 2180 | M12623 | Human non-histone chromosomal protein HMG-17 mRNA, complete cds. | 0.00E+00 |
| 2181 | U79143 | Human phosphoinositide 3'-hydroxykinase p110-alpha subunit mRNA, complete cds | 0.00E+00 |
| 2192 | K01906 | Human fetal liver c-myc proto-oncogene, exon 3 and flanks. | e-165 |
| 2194 | X74870 | *H.sapiens* gene for RNA pol II largest subunit, exons 23–29 | e-161 |
| 2235 | L16991 | Human thymidylate kinase (CDC8) mRNA, complete cds. | 0.00E+00 |
| 2257 | L08783 | BlueScribe M13 Plus cloning vector. | 0.00E+00 |
| 2276 | NM_002245.1 | *Homo sapiens* potassium inwardly-rectifying channel, subfamily K, member 1 (KCNK1) mRNA > :: gb|U33632|HSU33632 Human two P-domain K+ channel TWIK-1 mRNA, complete cds. | 0 |
| 2278 | D50734 | Rat mRNA of antizyme inhibitor, complete cds | e-157 |
| 2279 | U26401 | Human galactokinase (galK) mRNA, complete cds. > | 0.00E+00 |
| 2285 | U49058 | *Rattus norvegicus* CTD-binding SR-like protein rA4 mRNA, partial cds | e-138 |
| 2287 | X65306.1 | Cloning vector pGEM-3Zf(+) | e-116 |
| 2299 | NM_001172.1 | *Homo sapiens* arginase, type II (ARG2) mRNA > :: gb|U82256|HSU82256 *Homo sapiens* arginase type II mRNA, complete cds | e-127 |
| 2309 | M25160 | Human Na,K-ATPase beta subunit (ATP1B) gene, exons 3 through 6. | 0.00E+00 |
| 2315 | Y08736 | *H.sapiens* vegf gene, 3'UTR | 1.00E-78 |
| 2320 | U13737 | Human cysteine protease CPP32 isoform alpha mRNA, complete cds. | 0.00E+00 |
| 2323 | Y08135 | *M.musculus* mRNA for ASM-like phosphodiesterase 3a | e-148 |
| 2324 | Y08135 | *M.musculus* mRNA for ASM-like phosphodiesterase 3a | 0 |
| 2328 | NM_001677.1 | *Homo sapiens* ATPase, Na+/K+ transporting, beta 1 polypeptide (ATP1B1) mRNA > :: emb|X03747|HSATPBR Human mRNA for Na/K-ATPase beta subunit | 1E-77 |
| 2337 | Y08135 | *M.musculus* mRNA for ASM-like phosphodiesterase 3a | e-168 |
| 2364 | U54778 | Human 14-3-3 epsilon mRNA, complete cds | 1E-67 |
| 2365 | Y08135 | *M.musculus* mRNA for ASM-like phosphodiesterase 3a | 0 |
| 2368 | NM_001172.1 | *Homo sapiens* arginase, type II (ARG2) mRNA > :: gb|U82256|HSU82256 *Homo sapiens* arginase type II mRNA, complete cds | e-127 |
| 2385 | AB002293 | Human mRNA for KIAA0295 gene, partial cds | 0 |
| 2394 | M21188 | Human insulin-degrading enzyme (IDE) mRNA, complete cds. | 2E-81 |
| 2425 | D87466 | Human mRNA for KIAA0276 gene, partial cds | 1E-97 |
| 2429 | U58884 | *Mus musculus* SH3-containing protein SH3P7 mRNA, complete cds. similar to Human Drebrin | 4E-96 |
| 2441 | AB005216 | *Homo sapiens* mRNA for Nck, Ash and phospholipase C gamma-binding protein NAP4, partial cds | 0 |
| 2442 | NM_001960.1 | *Homo sapiens* eukaryotic translation elongation factor 1 delta (guanine nucleotide exchange protein) (EEF1D) mRNA > :: emb|Z21507|HSEF1DELA *H.sapiens* EF-1delta gene encoding human elongation factor-1-delta | 0.00E+00 |
| 2444 | M92449 | Human LTR mRNA, 3' end of coding region and 3' flank. | e-143 |
| 2452 | NM_003350.1 | *Homo sapiens* ubiquitin-conjugating enzyme E2 variant 2 (UBE2V2) mRNA > :: emb|X98091|HSVITDITR *H.sapiens* mRNA for protein induced by vitamin D | 0 |
| 2456 | U44975 | *Homo sapiens* DNA-binding protein CPBP (CPBP) mRNA, partial cds | 5.00E-69 |
| 2459 | Z84510 | *H.sapiens* flow-sorted chromosome 6 HindIII fragment, SC6pA28B7 | 4.00E-66 |

TABLE 2A-continued

Nearest Neighbor (BlastN vs. Genbank)

| SEQ ID | ACC'N | DESCRIP. | P VALUE |
|---|---|---|---|
| 2463 | Z48042 | *H.sapiens* mRNA encoding GPI-anchored protein p137 | e-172 |
| 2497 | U32986 | Human xeroderma pigmentosum group E UV-damaged DNA binding factor mRNA, complete cds. | 0 |
| 2515 | NM_003419 .1 | *Homo sapiens* zinc finger protein 10 (KOX 1) for zinc finger protein | e-129 |
| 2520 | Y00711 | Human mRNA for lactate dehydrogenase B (LDH-B) | 0.00E+00 |
| 2526 | Y10725 | *M.musculus* mRNA for protein kinase KIS | 0.00E+00 |
| 2543 | X62078 | *H.sapiens* mRNA for GM2 activator protein | e-164 |
| 2548 | NM_001009 .1 | *Homo sapiens* ribosomal protein S5 (RPS5) mRNA complete cds. | 0.00E+00 |
| 2556 | U97188 | *Homo sapiens* putative RNA binding protein KOC | 1E-86 |
| 2575 | NM_002852 .1 | *Homo sapiens* pentaxin-related gene, rapidly induced by IL-1 beta (PTX3) mRNA > :: emb|X63613|HSPTX3R *H.sapiens* mRNA for pentaxin (PTX3) | 0.00E+00 |
| 2578 | X67155 | *H.sapiens* mRNA for mitotic kinesin-like protein-1 | 0.00E+00 |
| 2588 | M54968 | Human K-ras oncogene protein mRNA, complete cds > | e-123 |
| 2591 | D88687 | *Homo sapiens* mRNA for KM-102-derived reductase-like factor, complete cds | 0 |
| 2593 | NM_001436 .1 | *Homo sapiens* fibrillarin (FBL) mRNA > :: gb|M59849|HUMFIBAA Human fibrillarin (Hfib1) mRNA, complete cds. | e-103 |
| 2595 | AB002326 | Human mRNA for KIAA0328 gene, partial cds | 0.00E+00 |
| 2598 | M11948 | Human promyelocytic leukemia cell mRNA, clones pHH58 and pHH81. | 9.00E-84 |

TABLE 2B

Nearest Neighbor (BlastX vs. Non-Redundant Proteins)

| SEQ ID | ACC'N | DESCRIP. | P VALUE |
|---|---|---|---|
| 37 | 4239895 | (AB016816) MASL1 [*Homo sapiens*] | 9.00E-54 |
| 66 | 4514653 | (AB024057) vascular Rab-GAP/TBC-containing protein [*Homo sapiens*] | 6.00E-55 |
| 78 | 4454524 | (AC004841) similar to insulin receptor substrate BAP2; similar to PID:g4126477 [*Homo sapiens*] | 6.00E-22 |
| 79 | 4545264 | (AF118240) peroxisomal biogenesis factor 16 [*Homo sapiens*] | 1.00E-45 |
| 112 | 3413938 | (AB007963) KIAA0494 protein [*Homo sapiens*] | 3.00E-44 |
| 122 | 4239895 | (AB016816) MASL1 [*Homo sapiens*] | 1.00E-47 |
| 139 | 4502371 | breast cancer antiestrogen resistance 3 > gi|3237306 (U92715) breast cancer antiestrogen resistance 3 protein [*Homo sapiens*] | 2.00E-44 |
| 154 | 4586880 | (AB017114) AD 3 [*Homo sapiens*] | 4.00E-48 |
| 157 | 3327170 | (AB014578) KIAA0678 protein [*Homo sapiens*] | 2.00E-51 |
| 168 | 3153241 | (AF053004) class I cytokine receptor [*Homo sapiens*] | 2.00E-17 |
| 171 | 4138233 | (AJ007780) parp-2 gene [*Mus musculus*] | 2.00E-32 |
| 174 | 3287173 | (AJ006266) AND-1 protein [*Homo sapiens*] | 2.00E-42 |
| 187 | 4507145 | UNKNOWN > gi|3873216 (AF065485) sorting nexin 4 [*Homo sapiens*] | 8.00E-46 |
| 207 | 4153860 | (AC005074) similar to U47321 (PID:g1245146) [*Homo sapiens*] | 4.00E-15 |
| 224 | 3236430 | (AF067379) ubiquitin-protein ligase E3-alpha [*Mus musculus*] | 3.00E-35 |
| 253 | 3043696 | (AB011158) KIAA0586 protein [*Homo sapiens*] | 1.00E-44 |
| 260 | 4519623 | (AB017616) homologous to the yeast YGR163 gene [*Mus musculus*] | 2.00E-54 |
| 280 | 4455035 | (AF116238) pseudouridine synthase 1 [*Homo sapiens*] | 4.00E-48 |
| 304 | 3075377 | (AC004602) F23487_2 [*Homo sapiens*] | 2.00E-21 |
| 306 | 4505611 | poly(A)-specific ribonuclease | 7.00E-41 |
| 373 | 1825606 | (U88169) similar to molybdoterin biosynthesis MOEB proteins [*Caenorhabditis elegans*] | 2.00E-37 |
| 382 | 4586287 | (AB004794) DUF140 [*Xenopus laevis*] | 7.00E-45 |
| 396 | 3941342 | (AF043250) mitochondrial outer membrane protein [*Homo sapiens*] > gi|3941347 (AF043253) mitochondrial outer membrane protein [*Homo sapiens*] > gi|4105703|gb|AAD02504| | 5.00E-40 |
| 414 | 4586844 | (AB015633) type II membrane protein | 2.00E-46 |
| 422 | 3327078 | (AB014532) KIAA0632 protein [*Homo sapiens*] | 6.00E-36 |
| 433 | 3327230 | (AB014608) KIAA0708 protein [*Homo sapiens*] | 5.00E-52 |
| 472 | 3372677 | (AF061749) tumorous imaginal discs protein Tid56 homolog | 7.00E-35 |
| 502 | 4050034 | (AF098482) transcriptional coactivator p52 [*Homo sapiens*] | 1.00E-36 |
| 504 | 4406632 | (AF131801) Unknown [*Homo sapiens*] | 3.00E-21 |
| 512 | 3114828 | (AJ005897) JM5 [*Homo sapiens*] | 3.00E-44 |

TABLE 2B-continued

Nearest Neighbor (BlastX vs. Non-Redundant Proteins)

| SEQ ID | ACC'N | DESCRIP. | P VALUE |
|---|---|---|---|
| 530 | 3766209 | (AF071777) IRE1 [*Mus musculus*] | 2.00E−29 |
| 561 | 3043644 | (AB011132) KIAA0560 protein [*Homo sapiens*] | 3.00E−43 |
| 572 | 3088575 | (AF059531) protein arginine N-methyltransferase 3 [*Homo sapiens*] | 4.00E−46 |
| 578 | 4505891 | UNKNOWN > gi|3153235 (AF046889) lysyl hydroxylase isoform 3 [*Homo sapiens*] > gi|3551836 | 3.00E−30 |
| 590 | 3114828 | (AJ005897) JM5 [*Homo sapiens*] | 1.00E−24 |
| 592 | 3242214 | (AJ006778) DRIM protein [*Homo sapiens*] | 2.00E−36 |
| 598 | 4200236 | (AL035308) hypothetical protein [*Homo sapiens*] | 8.00E−09 |
| 600 | 3413892 | (AB007934) KIAA0465 protein [*Homo sapiens*] | 2.00E−51 |
| 635 | 3043626 | (AB011123) KIAA0551 protein [*Homo sapiens*] | 3.00E−31 |
| 643 | 2498864 | RRP5 PROTEIN HOMOLOG (KIAA0185) hypothetical protein YM9959.11C of S.cerevisiae. [*Homo sapiens*] | 3.00E−13 |
| 670 | 3402197 | (AJ010014) M96A protein [*Homo sapiens*] | 1.00E−21 |
| 677 | 2217964 | (Z50798) p52 [*Gallus gallus*] | 7.00E−14 |
| 686 | 3043626 | (AB011123) KIAA0551 protein [*Homo sapiens*] | 1.00E−40 |
| 697 | 135470 | TUBULIN BETA-5 CHAIN sapiens] | 3.00E−21 |
| 701 | 3327056 | (AB014521) KIAA0621 protein [*Homo sapiens*] | 2.00E−29 |
| 704 | 4506787 | UNKNOWN GTPASE-ACTIVATING-LIKE PROTEIN IQGAP1 (P195) (KIAA0051) protein-human > gi|473931|dbj|BAA06123| (D29640) KIAA0051 [*Homo sapiens*] > gi|536844 (L33075) ras GTPase-activating-like protein [*Homo sapiens*] | 4.00E−41 |
| 709 | 1350762 | 60S RIBOSOMAL PROTEIN L6 sapiens] | 2.00E−22 |
| 713 | 2687400 | (AF035824) vesicle soluble NSF attachment protein receptor [*Homo sapiens*] | 1.00E−23 |
| 730 | 2914385 | Chain C, Human Pcna > gi|2914387|pdb|1AXC|E Chain E, Human Pcna | 2.00E−27 |
| 731 | 284076 | ERD-2-like protein, ELP-1-human | 1.00E−26 |
| 733 | 2497524 | KINESIN-LIKE PROTEIN KIF1B mouse > gi|407339|dbj|BAA04503| (D17577) Kif1b [*Mus musculus*] | 9.00E−33 |
| 735 | 3327056 | (AB014521) KIAA0621 protein [*Homo sapiens*] | 1.00E−13 |
| 736 | 279567 | insulinase (EC 3.4.99.45)-human | 2.00E−26 |
| 738 | 487416 | (L20302) actin filament protein [*Gallus gallus*] | 3.00E−45 |
| 739 | 1731428 | ZINC FINGER PROTEIN ZFP-38 | 7.00E−35 |
| 740 | 968973 | (U29156) involved in signaling by the epidermal growth factor receptor; Method: conceptual translation supplied by author. [*Mus musculus*] | 1.00E−22 |
| 741 | 1552350 | (Y08135) acid sphingomyelinase-like phosphodiesterase [*Mus musculus*] | 2.00E−35 |
| 742 | 3327098 | (AB014542) KIAA0642 protein [*Homo sapiens*] | 3.00E−15 |
| 743 | 3914801 | DNA-DIRECTED RNA POLYMERASE I 135 KD POLYPEPTIDE (RNA POLYMERASE I SUBUNIT 2) (RPA135) (RNA POLYMERASE I 127 KD SUBUNIT) > gi|2739048 (AF025424) RNA polymerase I 127 kDa subunit [*Rattus norvegicus*] | 2.00E−45 |
| 745 | 4165018 | (D89053) Acyl-CoA synthetase 3 [*Homo sapiens*] | 2.00E−53 |
| 746 | 968973 | (U29156) involved in signaling by the epidermal growth factor receptor; Method: conceptual translation supplied by author. [*Mus musculus*] | 3.00E−40 |
| 747 | 4519883 | (AB017970) dipeptidyl peptidase III | 4.00E−50 |
| 748 | 3327052 | (AB014519) KIAA0619 protein [*Homo sapiens*] | 7.00E−30 |
| 749 | 538413 | (L36315) zinc finger protein [*Mus musculus*] | 6.00E−55 |
| 750 | 1717793 | PROTEIN TSG24 (MEIOTIC CHECK POINT REGULATOR) > gi|1083553|pir||A55117 tsg24 protein-mouse | 1.00E−50 |
| 751 | 3420277 | (AF064826) glypican 4 [*Homo sapiens*] | 3.00E−54 |
| 808 | 4580645 | (AF118855) trans-prenyltransferase [*Mus musculus*] | 2.00E−48 |
| 829 | 3882171 | (AB018268) KIAA0725 protein [*Homo sapiens*] | 3.00E−24 |
| 833 | 4104976 | (AF043117) ubiquitin-fusion degradation protein 2 [*Homo sapiens*] | 2.00E−41 |
| 841 | 3242214 | (AJ006778) DRIM protein [*Homo sapiens*] | 4.00E−34 |
| 914 | 4191810 | (AB006532) DNA helicase [*Homo sapiens*] | 5.00E−41 |
| 959 | 3043714 | (AB011167) KIAA0595 protein [*Homo sapiens*] | 5.00E−20 |
| 982 | 4379097 | (Y17999) Dyrk1B protein kinase [*Homo sapiens*] | 3.00E−21 |
| 1028 | 3043712 | (AB011166) KIAA0594 protein [*Homo sapiens*] | 2.00E−49 |
| 1079 | 4240227 | (AB020676) KIAA0869 protein [*Homo sapiens*] | 4.00E−35 |
| 1091 | 4235226 | (AF061025) leucine zipper-EF-hand containing transmembrane protein 1 [*Homo sapiens*] | 6.00E−34 |
| 1134 | 3426268 | (AF044201) neural membrane protein 35; NMP35 [*Rattus norvegicus*] | 1.00E−29 |
| 1152 | 4507367 | threonyl-tRNA synthetase SYNTHETASE, CYTOPLASMIC (THREONINE--TRNA LIGASE) (THRRS) 6.1.1.3)-human > gi|1464742 (M63180) threonyl-tRNA synthetase [*Homo sapiens*] | 3.00E−26 |

TABLE 2B-continued

Nearest Neighbor (BlastX vs. Non-Redundant Proteins)

| SEQ ID | ACC'N | DESCRIP. | P VALUE |
|---|---|---|---|
| 1153 | 2072294 | (U95097) mitotic phosphoprotein 43 [Xenopus laevis] | 1.00E−19 |
| 1163 | 543222 | glutamine (Q)-rich factor 1, QRF-1-mouse factor 1, QRF-1 [mice, B-cell leukemia, BCL1, Peptide Partial, 84 aa] | 1.00E−39 |
| 1164 | 3335569 | (AF072759) fatty acid transport protein 4; FATP4 [Mus musculus] | 7.00E−39 |
| 1168 | 2996194 | (AF053232) SIK similar protein [Mus musculus] | 1.00E−31 |
| 1172 | 2935597 | (AC004262) R29368_2 [Homo sapiens] | 6.00E−49 |
| 1201 | 2645205 | (U63648) p160 myb-binding protein [Mus musculus] | 1.00E−21 |
| 1204 | 1407655 | (U58884) SH3P7 [Mus musculus] | 8.00E−21 |
| 1214 | 2134381 | polybromo 1 protein-chicken | 8.00E−29 |
| 1219 | 4505613 | PRKC, apoptosis, WT1, regulator par-4 [Homo sapiens] | 6.00E−34 |
| 1229 | 3757892 | (AF079765) enhancer of polycomb [Mus musculus] | 3.00E−41 |
| 1231 | 2134436 | zinc finger protein-chicken (fragment) | 4.00E−37 |
| 1232 | 2393722 | (U90313) glutathione-S-transferase homolog [Homo sapiens] | 6.00E−34 |
| 1234 | 459002 | (U00036) R151.6 gene product [Caenorhabditis elegans] | 7.00E−10 |
| 1236 | 119530 | PROTEIN DISULFIDE ISOMERASE-RELATED PROTEIN PRECURSOR (ERP72) > gi\|87320\|pir\|\|A23723 protein disulfide-isomerase (EC 5.3.4.1) ERp72 precursor-human protein [Homo sapiens] | 3.00E−23 |
| 1239 | 2073541 | (L19437) transaldolase [Homo sapiens] > gi\|2612879 | 2.00E−24 |
| 1241 | 984125 | (X90857)-14 [Homo sapiens] | 2.00E−23 |
| 1245 | 4106818 | (AF083395) phospholipase A2-activating protein [Homo sapiens] | 4.00E−36 |
| 1247 | 4507955 | YY1 transcription factor REPRESSOR PROTEIN YY1 (YIN AND YANG 1) (YY-1) (DELTA TRANSCRIPTION FACTOR) (NF-E1) > gi\|38011\|emb\|CAA78455\| | 4.00E−27 |
| 1250 | 1698779 | (U70372) PAM COOH-terminal interactor protein 2 [Rattus norvegicus] | 6.00E−35 |
| 1252 | 4204684 | (AF102542) beta-1,6-N-acetylglucosaminyltransferase core 2/core 4 beta-1,6-N-acetylglucosaminyltransferase; core 2/4-GnT [Homo sapiens] | 9.00E−43 |
| 1255 | 2239126 | (Y10746) methyl-CpG binding protein [Homo sapiens] | 4.00E−16 |
| 1259 | 1747519 | (U76759) nuclear protein NIP45 [Mus musculus] | 2.00E−29 |
| 1260 | 545790 | DARPP-32 = dopamine and cAMP-regulated phosphoprotein [human, brain, Peptide, 204 aa] sapiens] | 1.00E−29 |
| 1261 | 1709689 | PEPTIDE METHIONINE SULFOXIDE REDUCTASE (PEPTIDE MET(O) REDUCTASE) > gi\|1205993 taurus] | 1.00E−37 |
| 1265 | 2736151 | (AF021935) myotonic dystrophy kinase-related Cdc42-binding kinase [Rattus norvegicus] | 1.00E−41 |
| 1267 | 3329392 | (AF038961) SL15 protein [Homo sapiens] | 8.00E−36 |
| 1268 | 4097712 | (U67322) HBV associated factor [Homo sapiens] | 7.00E−56 |
| 1269 | 585084 | ELONGATION FACTOR G, MITOCHONDRIAL PRECURSOR (MEF-G) > gi\|543383\|pir\|\|S40780 translation elongation factor G, mitochondrial-rat > gi\|310102 | 7.00E−49 |
| 1270 | 1438534 | (U49057) rA9 [Rattus norvegicus] | 3.00E−45 |
| 1271 | 1336628 | (U57368) EGF repeat transmembrane protein [Mus musculus] | 7.00E−47 |
| 1272 | 3914802 | DNA-DIRECTED RNA POLYMERASE I LARGEST SUBUNIT (RNA POLYMERASE I 194 KD SUBUNIT) (RPA194) | 1.00E−37 |
| 1273 | 3387977 | (AF070598) ABC transporter [Homo sapiens] | 5.00E−50 |
| 1274 | 1717793 | PROTEIN TSG24 (MEIOTIC CHECK POINT REGULATOR) > gi\|1083553\|pir\|\|A55117 tsg24 protein-mouse | 2.00E−48 |
| 1275 | 2493735 | SKD3 PROTEIN SKD3 [Mus musculus] | 7.00E−43 |
| 1276 | 1041038 | (D78020) NFI-A4 [Rattus norvegicus] | 3.00E−26 |
| 1284 | 4455118 | (AF125158) zinc finger DNA binding protein 99 | 9.00E−41 |
| 1322 | 4049922 | (AF072810) transcription factor WSTF [Homo sapiens] | 4.00E−48 |
| 1338 | 4586287 | (AB004794) DUF140 [Xenopus laevis] | 3.00E−45 |
| 1345 | 3435244 | (AF083322) centriole associated protein CEP110 [Homo sapiens] | 2.00E−40 |
| 1370 | 3413886 | (AB007931) KIAA0462 protein [Homo sapiens] | 2.00E−35 |
| 1462 | 3882311 | (AB018338) KIAA0795 protein [Homo sapiens] | 4.00E−47 |
| 1497 | 4240167 | (AB020646) KIAA0839 protein [Homo sapiens] | 2.00E−46 |
| 1517 | 4191610 | (AF117107) IGF-II mRNA-binding protein 2 [Homo sapiens] | 3.00E−49 |
| 1519 | 3135669 | (AF064084) prenylcysteine carboxyl methyltransferase | 1.00E−39 |
| 1529 | 3043548 | (AB011084) KIAA0512 protein [Homo sapiens] | 2.00E−47 |
| 1531 | 3093476 | (AF008915) EVI-5 homolog [Homo sapiens] | 6.00E−19 |
| 1532 | 3834629 | (AF094519) diaphanous-related formin; p134 mDia2 [Mus musculus] | 1.00E−32 |
| 1533 | 3193226 | (AF068706) gamma2-adaptin [Homo sapiens] | 1.00E−46 |
| 1534 | 3851584 | (AF092563) chromosome-associated protein-E [Homo sapiens] | 4.00E−48 |
| 1535 | 4101695 | (AF006010) progestin induced protein [Homo sapiens] | 5.00E−30 |
| 1550 | 3850704 | (AJ005273) Kin17 [Homo sapiens] | 9.00E−24 |
| 1553 | 4240147 | (AB020636) KIAA0829 protein [Homo sapiens] | 9.00E−41 |

TABLE 2B-continued

Nearest Neighbor (BlastX vs. Non-Redundant Proteins)

| SEQ ID | ACC'N | DESCRIP. | P VALUE |
|---|---|---|---|
| 1554 | 2137490 | lymphocyte specific helicase-mouse *musculus*] | 5.00E−35 |
| 1561 | 3327052 | (AB014519) KIAA0619 protein [*Homo sapiens*] | 1.00E−41 |
| 1563 | 2137494 | M-sema F protein precusor-mouse F [mice, neonatal brain, Peptide, 834 aa] [*Mus* sp.] nuclear receptor co-repressor N-CoR-mouse *musculus*] | 7.00E−34 |
| 1564 | 2137603 | > gi|1583865|prf||12121436A thyroid hormone receptor co-repressor [*Mus musculus*] | 9.00E−41 |
| 1565 | 2674107 | (AF023451) guanine nucleotide-exchange protein [*Bos taurus*] | 3.00E−48 |
| 1587 | 3659505 | (AC005084) similar to mouse mCASK-A; similar to e1288039 | 1.00E−57 |
| 1649 | 114762 | NUCLEOPHOSMIN (NPM) (NUCLEOLAR PHOSPHOPROTEIN B23) (NUMATRIN) (NUCLEOLAR PROTEIN NO38) *sapiens*] | 6.00E−35 |
| 1651 | 3327056 | (AB014521) KIAA0621 protein [*Homo sapiens*] | 8.00E−40 |
| 1688 | 4545264 | (AF118240) peroxisomal biogenesis factor 16 [*Homo sapiens*] | 2.00E−65 |
| 1694 | 2498864 | RRP5 PROTEIN HOMOLOG (KIAA0185) hypothetical protein YM9959.11C of S.cerevisiae. [*Homo sapiens*] | 7.00E−77 |
| 1758 | 3420277 | (AF064826) glypican 4 [*Homo sapiens*] | 4.00E−76 |
| 1768 | 3088575 | (AF059531) protein arginine N-methyltransferase 3 [*Homo sapiens*] | 7.00E−97 |
| 1771 | 4050034 | (AF098482) transcriptional coactivator p52 [*Homo sapiens*] | 2.00E−58 |
| 1811 | 4506357 | UNKNOWN; PZR > gi|3851145 *sapiens*] | 2.00E−60 |
| 1830 | 3387977 | (AF070598) ABC transporter [*Homo sapiens*] | e-113 |
| 1836 | 1709974 | 60S RIBOSOMAL PROTEIN L10A protein L10a [*Rattus norvegicus*] Ribosomal Protein RPL10A) [*Homo sapiens*] | e-111 |
| 1838 | 4507709 | tissue specific transplantation antigen P35B > gi|1381179 (U58766) FX [*Homo sapiens*] | 9.00E−90 |
| 1876 | 1117791 | (U18297) MST1 [*Homo sapiens*] | 4E-85 |
| 1877 | 4507015 | copper transporter 1 | 3.00E−72 |
| 1897 | 4503301 | 2,4-dienoyl CoA reductase REDUCTASE, MITOCHONDRIAL PRECURSOR (2,4-DIENOYL-COA REDUCTASE (NADPH)) (4-ENOYL-COA REDUCTASE (NADPH)) precursor, mitochondrial-human > gi|602703 (L26050) 2,4-dienoyl-CoA reductase [*Homo sapiens*] > gi|2673979 precursor [*Homo sapiens*] > gi|4126313 (AF049895) 2,4-dienoyl-CoA reductase [*Homo sapiens*] | 6E-94 |
| 1901 | 126743 | MICROTUBULE-ASSOCIATED PROTEIN 4 human > gi|187383 (M64571) microtubule-associated protein 4 [*Homo sapiens*] | 6E-84 |
| 1914 | 4505987 | PTPRF interacting protein, binding protein 1 (liprin beta 1) > gi|3309539 (AF034802) liprin-beta1 [*Homo sapiens*] | 4E-89 |
| 1920 | 3043644 | (AB011132) KIAA0560 protein [*Homo sapiens*] | e-108 |
| 1944 | 3413892 | (AB007934) KIAA0465 protein [*Homo sapiens*] | 7.00E−87 |
| 1956 | 4185796 | (AF103796) placenta-specific ATP-binding cassette transporter [*Homo sapiens*] | 2E-68 |
| 1973 | 4507145 | UNKNOWN > gi|3873216 (AF065485) sorting nexin 4 [*Homo sapiens*] | 1.00E−73 |
| 2008 | 1083566 | zinc finger protein/transactivator Zfp-38-mouse > gi|55477 |emb| CAA45280| (X63747) Zfp-38 [*Mus musculus*] | 2E-64 |
| 2018 | 1806134 | (Z67747) zinc finger protein [*Mus musculus*] | 7.00E−78 |
| 2032 | 730451 | 60S RIBOSOMAL PROTEIN L13A (23 KD HIGHLY BASIC PROTEIN) > gi|345897|pir||S29539 basic protein, 23K-human > gi|23691|emb|CAA40254| (X56932) 23 kD highly basic protein [*Homo sapiens*] | 4.00E−87 |
| 2285 | 4102967 | (AF023142) pre-mRNA splicing SR protein rA4 [*Homo sapiens*] | 1.00E−33 |
| 2317 | 3108093 | (AF061258) LIM protein [*Homo sapiens*] | 6.00E−82 |
| 2318 | 3170887 | (AF061555) ubiquitin-protein ligase E3-alpha [*Mus musculus*] | e-104 |
| 2324 | 1552350 | (Y08135) acid sphingomyelinase-like phosphodiesterase [*Mus musculus*] | 6.00E−91 |
| 2365 | 1552350 | (Y08135) acid sphingomyelinase-like phosphodiesterase [*Mus musculus*] | e-106 |
| 2366 | 3242214 | (AJ006778) DRIM protein [*Homo sapiens*] | e-114 |
| 2387 | 4514653 | (AB024057) vascular Rab-GAP/TBC-containing protein [*Homo sapiens*] | e-121 |
| 2441 | 2443367 | (AB005216) Nck, Ash and phospholipase C gamma-binding protein NAP4 [*Homo sapiens*] | e-120 |
| 2475 | 119110 | EBNA-1 NUCLEAR PROTEIN herpesvirus 4 (strain B95-8) > gi|1334880|emb|CAA24816.1| gene. [Human herpesvirus 4] | 2.00E−38 |
| 2479 | 121640 | GLYCINE-RICH CELL WALL STRUCTURAL PROTEIN PRECURSOR > gi|72320|pir||KNMU glycine-rich cell wall protein precursor-*Arabidopsis thaliana* | 8.00E−31 |
| 2495 | 1362077 | glycin-rich protein-cowpea (fragment) | 2E-40 |

TABLE 2B-continued

Nearest Neighbor (BlastX vs. Non-Redundant Proteins)

| SEQ ID | ACC'N | DESCRIP. | P VALUE |
|---|---|---|---|
| 2519 | 121640 | GLYCINE-RICH CELL WALL STRUCTURAL PROTEIN PRECURSOR > gi|72320|pir||KNMU glycine-rich cell wall protein precursor-*Arabidopsis thaliana* | 9.00E−27 |
| 2546 | 2674107 | (AF023451) guanine nucleotide-exchange protein [*Bos taurus*] | 5E−89 |
| 2548 | 3717978 | (Y12431) 5S ribosomal protein [*Mus musculus*] | 5E−94 |
| 2556 | 4191610 | (AF117107) IGF-II mRNA-binding protein 2 [*Homo sapiens*] | e−111 |
| 2578 | 2119281 | CHO1 antigen-Chinese hamster | e−101 |
| 2579 | 3435244 | (AF083322) centriole associated protein CEP110 [*Homo sapiens*] | 2E−70 |
| 2591 | 1843434 | (D88687) KM-102-derived reductase-like factor [*Homo sapiens*] | 4.00E−91 |
| 2604 | 3834629 | (AF094519) diaphanous-related formin; p134 mDia2 [*Mus musculus*] | 1E−49 |

TABLE 3A

Profile Hits

| SEQ ID NO: | Description | Start | Stop | Dir |
|---|---|---|---|---|
| 1967 | 14_3_3 proteins | 166 | 845 | for |
| 2366 | 3'5'-cyclic nucleotide phosphodiesterases | 64 | 573 | for |
| 1579 | 4 transmembrane integral membrane proteins | 300 | 924 | rev |
| 1978 | 4 transmembrane integral membrane proteins | 340 | 941 | rev |
| 1652 | 7 transmembrane receptor (rhodopsin family) | 109 | 647 | rev |
| 1927 | 7 transmembrane receptor (rhodopsin family) | 84 | 947 | rev |
| 2068 | 7 transmembrane receptor (rhodopsin family) | 305 | 975 | for |
| 1598 | 7 transmembrane receptor (Secretin family) | 50 | 1269 | for |
| 1719 | 7 transmembrane receptor (Secretin family) | 63 | 1160 | rev |
| 1911 | 7 transmembrane receptor (Secretin family) | 38 | 869 | rev |
| 1927 | 7 transmembrane receptor (Secretin family) | 237 | 930 | rev |
| 2068 | 7 transmembrane receptor (Secretin family) | 188 | 975 | for |
| 2341 | 7 transmembrane receptor (Secretin family) | 377 | 1524 | rev |
| 1671 | ATPases Associated with Various Cellular Activities | 136 | 718 | for |
| 1672 | ATPases Associated with Various Cellular Activities | 271 | 765 | for |
| 1688 | ATPases Associated with Various Cellular Activities | 206 | 709 | rev |
| 1796 | ATPases Associated with Various Cellular Activities | 139 | 783 | for |
| 1830 | ATPases Associated with Various Cellular Activities | 265 | 713 | for |
| 1872 | ATPases Associated with Various Cellular Activities | 152 | 616 | rev |
| 1913 | ATPases Associated with Various Cellular Activities | 12 | 510 | for |
| 1922 | ATPases Associated with Various Cellular Activities | 125 | 658 | for |
| 1964 | ATPases Associated with Various Cellular Activities | 97 | 752 | for |
| 1997 | ATPases Associated with Various Cellular Activities | 185 | 664 | for |
| 2032 | ATPases Associated with Various Cellular Activities | 69 | 485 | for |
| 2170 | ATPases Associated with Various Cellular Activities | 73 | 550 | for |
| 2177 | ATPases Associated with Various Cellular Activities | 340 | 928 | for |
| 2290 | ATPases Associated with Various Cellular Activities | 872 | 1390 | rev |
| 2343 | ATPases Associated with Various Cellular Activities | 122 | 635 | for |
| 2358 | ATPases Associated with Various Cellular Activities | 84 | 492 | rev |
| 2390 | ATPases Associated with Various Cellular Activities | 31 | 434 | rev |
| 2414 | ATPases Associated with Various Cellular Activities | 953 | 1358 | rev |
| 2461 | ATPases Associated with Various Cellular Activities | 192 | 690 | rev |
| 2476 | ATPases Associated with Various Cellular Activities | 51 | 593 | for |
| 2482 | ATPases Associated with Various Cellular Activities | 135 | 615 | rev |
| 2578 | ATPases Associated with Various Cellular Activities | 0 | 673 | for |
| 1623 | Basic region plus leucine zipper transcription factors | 81 | 277 | for |
| 1715 | C2 domain (prot. kinase C like) | 403 | 582 | for |
| 2426 | C2 domain (prot. kinase C like) | 493 | 637 | for |
| 2238 | Cysteine proteases | 359 | 984 | for |
| 1630 | DEAD and DEAH box helicases | 34 | 690 | rev |
| 1865 | DEAD and DEAH box helicases | 43 | 753 | for |
| 2517 | DEAD and DEAH box helicases | 426 | 719 | for |
| 1714 | Dual specificity phosphatase, catalytic domain | 365 | 696 | rev |
| 1728 | Dual specificity phosphatase, catalytic domain | 243 | 597 | for |
| 2087 | Dual specificity phosphatase, catalytic domain | 786 | 1566 | for |
| 1595 | EF-hand | 556 | 630 | for |
| 1671 | Eukaryotic aspartyl proteases | 116 | 763 | for |
| 1778 | Eukaryotic aspartyl proteases | 92 | 1008 | for |
| 1903 | Eukaryotic aspartyl proteases | 73 | 603 | rev |
| 1945 | Eukaryotic aspartyl proteases | 147 | 694 | rev |
| 1963 | Eukaryotic aspartyl proteases | 38 | 740 | rev |
| 1991 | Eukaryotic aspartyl proteases | 404 | 1113 | rev |
| 2130 | Eukaryotic aspartyl proteases | 237 | 829 | rev |
| 2138 | Eukaryotic aspartyl proteases | 117 | 729 | rev |
| 2193 | Eukaryotic aspartyl proteases | 217 | 1397 | rev |
| 2290 | Eukaryotic aspartyl proteases | 413 | 1366 | rev |
| 2291 | Eukaryotic aspartyl proteases | 8 | 710 | rev |
| 2348 | Eukaryotic aspartyl proteases | 291 | 1146 | rev |
| 2430 | Eukaryotic aspartyl proteases | 216 | 1158 | rev |
| 2496 | Eukaryotic aspartyl proteases | 228 | 659 | for |
| 2523 | Eukaryotic aspartyl proteases | 276 | 1291 | rev |
| 2589 | Eukaryotic aspartyl proteases | 525 | 1431 | for |
| 1968 | Fibronectin type II domain | 455 | 565 | rev |
| 1779 | G-protein alpha subunit | 24 | 583 | rev |
| 1621 | Helicases conserved C-terminal domain | 160 | 309 | for |
| 1652 | Helicases conserved C-terminal domain | 363 | 560 | rev |
| 2192 | Helix-loop-helix DNA binding domain | 224 | 382 | for |
| 2181 | kinase domain of tors | 474 | 713 | for |
| 1825 | mkk like kinases | 17 | 626 | rev |
| 1876 | mkk like kinases | 35 | 719 | for |
| 2039 | mkk like kinases | 114 | 527 | for |
| 2526 | mkk like kinases | 9 | 463 | for |
| 1782 | Neurotransmitter-gated ion-channel | 267 | 1411 | for |
| 1922 | Neurotransmitter-gated ion-channel | 367 | 1168 | for |
| 2068 | Neurotransmitter-gated ion-channel | 222 | 1024 | for |

TABLE 3A-continued

Profile Hits

| SEQ ID NO: | Description | Start | Stop | Dir |
|---|---|---|---|---|
| 2102 | Neurotransmitter-gated ion-channel | 352 | 1273 | for |
| 2154 | Neurotransmitter-gated ion-channel | 377 | 1159 | for |
| 2538 | Neurotransmitter-gated ion-channel | 112 | 1120 | for |
| 1621 | protein kinase | 153 | 743 | for |
| 1630 | protein kinase | 123 | 904 | for |
| 1705 | protein kinase | 471 | 1072 | for |
| 1706 | protein kinase | 190 | 609 | for |
| 1710 | protein kinase | 235 | 641 | for |
| 1744 | protein kinase | 8 | 711 | rev |
| 1767 | protein kinase | 90 | 537 | for |
| 1776 | protein kinase | 200 | 524 | rev |
| 1782 | protein kinase | 706 | 1331 | for |
| 1822 | protein kinase | 24 | 666 | for |
| 1825 | protein kinase | 56 | 593 | rev |
| 1844 | protein kinase | 263 | 824 | for |
| 1850 | protein kinase | 217 | 779 | for |
| 1876 | protein kinase | 290 | 711 | for |
| 1977 | protein kinase | 38 | 776 | for |
| 2051 | protein kinase | 14 | 657 | for |
| 2112 | protein kinase | 202 | 644 | rev |
| 2169 | protein kinase | 1 | 656 | for |
| 2205 | protein kinase | 57 | 689 | for |
| 2242 | protein kinase | 33 | 646 | for |
| 2291 | protein kinase | 630 | 1148 | rev |
| 2454 | protein kinase | 49 | 761 | rev |
| 2526 | protein kinase | 0 | 463 | for |
| 2558 | protein kinase | 77 | 590 | for |
| 1719 | Protein Tyrosine Phosphatase | 82 | 482 | rev |
| 1769 | Protein Tyrosine Phosphatase | 71 | 461 | rev |
| 2062 | Protein Tyrosine Phosphatase | 270 | 704 | for |
| 2197 | Protein Tyrosine Phosphatase | 359 | 851 | for |
| 2275 | Protein Tyrosine Phosphatase | 56 | 680 | for |
| 1850 | RNA recognition motif. (aka RRM, RBD, or RNP domain) | 165 | 365 | for |
| 2194 | RNA recognition motif. (aka RRM, RBD, or RNP domain) | 37 | 174 | for |
| 2441 | SH2 Domain | 201 | 362 | for |
| 1618 | Thioredoxins | 253 | 554 | for |
| 1579 | Trypsin | 252 | 1007 | rev |
| 2290 | Trypsin | 350 | 1164 | rev |
| 2341 | Trypsin | 447 | 1211 | rev |
| 2421 | Trypsin | 14 | 765 | rev |
| 2430 | Trypsin | 700 | 1556 | rev |
| 2438 | Trypsin | 47 | 670 | rev |
| 2281 | WD domain, G-beta repeats | 70 | 161 | for |
| 1579 | wnt family of developmental signaling proteins | 282 | 1017 | rev |
| 1653 | wnt family of developmental signaling proteins | 154 | 978 | rev |
| 1778 | wnt family of developmental signaling proteins | 38 | 858 | rev |
| 1826 | wnt family of developmental signaling proteins | 574 | 1318 | rev |
| 1875 | wnt family of developmental signaling proteins | 578 | 1313 | rev |
| 1904 | wnt family of developmental signaling proteins | 205 | 1068 | rev |
| 1992 | wnt family of developmental signaling proteins | 2 | 824 | rev |
| 2004 | wnt family of developmental signaling proteins | 621 | 1420 | rev |
| 2129 | wnt family of developmental signaling proteins | 394 | 1343 | rev |
| 2145 | wnt family of developmental signaling proteins | 162 | 1027 | rev |
| 2204 | wnt family of developmental signaling proteins | 274 | 1405 | rev |
| 2238 | wnt family of developmental signaling proteins | 560 | 1195 | rev |
| 2290 | wnt family of developmental signaling proteins | 250 | 1273 | rev |
| 2291 | wnt family of developmental signaling proteins | 523 | 1409 | rev |
| 2294 | wnt family of developmental signaling proteins | 297 | 1237 | rev |
| 2341 | wnt family of developmental signaling proteins | 51 | 1002 | rev |
| 2343 | wnt family of developmental signaling proteins | 28 | 1180 | rev |
| 2348 | wnt family of developmental signaling proteins | 638 | 1614 | rev |
| 2373 | wnt family of developmental signaling proteins | 30 | 1078 | rev |
| 2409 | wnt family of developmental signaling proteins | 4 | 1074 | rev |
| 2410 | wnt family of developmental signaling proteins | 208 | 1107 | rev |
| 2414 | wnt family of developmental signaling proteins | 242 | 1068 | rev |
| 2421 | wnt family of developmental signaling proteins | 159 | 1057 | rev |
| 2430 | wnt family of developmental signaling proteins | 844 | 1691 | rev |
| 2436 | wnt family of developmental signaling proteins | 107 | 784 | rev |
| 2438 | wnt family of developmental signaling proteins | 127 | 1226 | rev |
| 2463 | wnt family of developmental signaling proteins | 5 | 704 | rev |
| 2473 | wnt family of developmental signaling proteins | 328 | 1193 | rev |
| 2511 | wnt family of developmental signaling proteins | 341 | 1222 | rev |
| 2523 | wnt family of developmental signaling proteins | 820 | 1617 | rev |
| 2528 | wnt family of developmental signaling proteins | 461 | 1283 | rev |
| 1735 | Zinc finger, C2H2 type | 495 | 557 | for |
| 1942 | Zinc finger, C2H2 type | 500 | 562 | for |
| 2018 | Zinc finger, C2H2 type | 279 | 341 | for |
| 2254 | Zinc finger, C2H2 type | 148 | 210 | for |
| 2515 | Zinc finger, C2H2 type | 422 | 484 | for |

TABLE 3B

Profile Hits for Contigs

| SEQ ID NO: | Description | Start | Stop | Dir |
|---|---|---|---|---|
| 2641 | ATPases Associated with Various Cellular Activities | 118 | 661 | for |
| 2655 | ATPases Associated with Various Cellular Activities | 135 | 536 | for |
| 2685 | ATPases Associated with Various Cellular Activities | 142 | 574 | for |
| 2648 | DEAD and DEAH box helicases | 66 | 931 | rev |
| 2686 | Helicases conserved C-terminal domain | 51 | 242 | for |
| 2661 | Neurotransmitter-gated ion-channel | 169 | 738 | rev |
| 2640 | Protein phosphatase 2A regulatory subunit PR55 | 275 | 1510 | for |
| 2655 | Protein phosphatase 2A regulatory subunit PR55 | 55 | 1087 | for |
| 2670 | Protein phosphatase 2A regulatory subunit PR55 | 13 | 1183 | for |
| 2684 | Protein phosphatase 2A regulatory subunit PR55 | 511 | 1861 | rev |
| 2679 | Protein Tyrosine Phosphatase | 292 | 768 | for |
| 2668 | Thioredoxins | 182 | 475 | for |

TABLE 22

Deposits of Pooled Clones

| ES34 | ES35 | ES36 | ES37 |
|---|---|---|---|
| M00006992C:G02 | M00005468A:D08 | M00005452C:A02 | M00022171D:B08 |
| M00006756D:E10 | M00021892B:H03 | M00001382C:C09 | M00008061A:F02 |
| M00003984C:F04 | M00001390A:C06 | M00004841C:B09 | M00003820C:A09 |
| M00007125D:E03 | M00022074D:F11 | M00001441D:H05 | M00022109B:A11 |
| M00006650A:A10 | M00005460B:D02 | M00022716D:D08 | M00005342D:F03 |
| M00001452B:H06 | M00024423B:D03 | M00022828C:E04 | M00022070B:C10 |
| M00022972D:C10 | M00007140A:F11 | M00004350B:F06 | M00006966B:B09 |
| M00022305C:A01 | M00004081B:C11 | M00005685B:D08 | M00022381C:C12 |
| M00007010B:H01 | M00005480A:H12 | M00004190A:A09 | M00003991B:B05 |
| M00021946D:C11 | M00008015D:E09 | M00004054D:D02 | M00022404D:G05 |

| ES38 | ES39 | ES40 | ES41 |
|---|---|---|---|
| M00021912B:H11 | M00007118B:B04 | M00006993B:B09 | M00007974B:C11 |
| M00005378C:A10 | M00007019A:B01 | M00004242C:C01 | M00021860B:G06 |
| M00022578C:B07 | M00021682B:D12 | M00007986C:C05 | M00006927C:F12 |
| M00005513A:D08 | M00005411D:A03 | M00004115A:G09 | M00022582C:E12 |
| M00022176C:A08 | M00006641C:H02 | M00022600C:A06 | M00006618C:G08 |
| M00006822D:F07 | M00007041C:C05 | M00005384A:A01 | M00005450B:B01 |
| M00004031A:B04 | M00005444B:E11 | M00021667E:E03 | M00001417B:E01 |
| M00021927D:D12 | M00022745B:G02 | M00008078C:C06 | M00003825B:A05 |
| M00001553D:B06 | M00022685A:F11 | M00007985A:B09 | M00001370B:B04 |
| M00022404B:H05 | M00004446A:G01 | M00007953B:B03 | M00006727B:E09 |

| ES42 | ES43 | ES44 | ES45 |
|---|---|---|---|
| M00001478A:B06 | M00006923B:H08 | M00006615B:F05 | M00005468D:F04 |
| M00003972B:A11 | M00005377D:F11 | M00005486C:B03 | M00006720C:C11 |
| M00005477C:D08 | M00006640B:H09 | M00007124C:A11 | M00005817D:E12 |
| M00006745A:A01 | M00005404C:F02 | M00006995D:A03 | M00001669B:A03 |
| M00007090B:A02 | M00004030A:G12 | M00007149D:G06 | M00003998A:G12 |
| M00007152A:B04 | M00006704D:D03 | M00006990D:D06 | M00004045A:B12 |
| M00006953B:H10 | M00006810D:A05 | M00005530B:E04 | M00004130D:E04 |
| M00005399D:B02 | M00005481C:A05 | M00003918C:E07 | M00004160A:D07 |
| M00006987B:F04 | M00005411A:C07 | M00007163A:B10 | M00001655A:F07 |
| M00005772A:F03 | M00003970A:G10 | M00005485C:A03 | M00001468D:D11 |

| ES46 | | | |
|---|---|---|---|
| M00004217A:A05 | | | |
| M00004183D:B07 | | | |
| M00001415D:A05 | | | |
| M00004158C:F03 | | | |
| M00004031D:G02 | | | |

TABLE 23

Library Deposits

| ES47 | ES48 | ES49 | ES50 |
|---|---|---|---|
| M00001399D:F09 | M00004217D:G10 | M00004508A:G12 | M00021653A:G07 |
| M00001455A:C03 | M00004218C:G10 | M00004508B:G02 | M00021654C:A02 |
| M00001456C:F02 | M00004252D:H08 | M00001432B:H08 | M00021660C:G04 |
| M00001487D:G03 | M00004253B:A10 | M00001432C:G01 | M00021665A:D04 |
| M00001539B:B01 | M00004253C:F06 | M00003992D:G01 | M00021670B:G11 |
| M00001565A:A02 | M00004253C:E10 | M00005326B:F03 | M00021678A:B08 |
| M00001572C:E07 | M00004260A:B07 | M00005332A:H10 | M00021680B:C01 |
| M00001582D:B10 | M00004260C:A12 | M00005342A:C04 | M00021681C:B10 |
| M00001584C:A03 | M00004260C:E10 | M00005342A:D04 | M00021690D:E05 |
| M00001586A:F09 | M00001339B:A03 | M00005349B:G01 | M00021692A:E03 |
| M00001588D:H08 | M00001342C:A04 | M00005352B:D02 | M00021692C:E06 |
| M00001610B:A01 | M00001344D:G11 | M00005354C:E02 | M00021694B:A07 |
| M00001618B:F02 | M00001345A:A12 | M00005356A:D09 | M00021698B:B12 |
| M00001618C:E06 | M00001347A:G06 | M00005359D:G07 | M00021828A:C08 |
| M00001621C:A04 | M00001347B:H01 | M00005378A:A08 | M00021841C:D07 |
| M00001626B:H05 | M00001353B:D11 | M00005383D:D06 | M00021859A:D04 |
| M00001641B:G05 | M00001355A:A01 | M00005383E:E07 | M00021861C:A02 |
| M00001648C:F06 | M00001358D:D09 | M00005385C:G05 | M00021862A:A04 |
| M00001649D:H05 | M00001359A:B07 | M00005388D:F09 | M00021862D:F01 |
| M00001656D:F11 | M00001362A:C10 | M00005390B:G10 | M00021886D:E04 |
| M00001660A:F10 | M00001362B:A09 | M00005397C:B03 | M00021897B:A06 |

TABLE 23-continued

Library Deposits

| ES47 | ES48 | ES49 | ES50 |
|---|---|---|---|
| M00001669A:H11 | M00001365D:D12 | M00005399A:D01 | M00021905A:G05 |
| M00003741A:E01 | M00001365D:H09 | M00005409D:C02 | M00021905B:A01 |
| M00003745C:E03 | M00001370A:G09 | M00005415C:G08 | M00021906C:G11 |
| M00003746A:E01 | M00001370B:B12 | M00005417A:E10 | M00021910A:C10 |
| M00003748B:B06 | M00001374D:D09 | M00005442D:C05 | M00021927A:C11 |
| M00003749B:C08 | M00001376B:C11 | M00005446A:G01 | M00021927B:F01 |
| M00003749D:G07 | M00001377A:D03 | M00005446C:D12 | M00021932C:C05 |
| M00003752A:B06 | M00001377A:E01 | M00005454C:H12 | M00021932C:G10 |
| M00003752D:D09 | M00001377C:B08 | M00005455A:D01 | M00021947A:C01 |
| M00003753C:B01 | M00001387A:A04 | M00005455A:G03 | M00021952B:F11 |
| M00003754C:F01 | M00001387D:C07 | M00005462C:B02 | M00021954A:A03 |
| M00003756C:C08 | M00001389B:B06 | M00005469D:C11 | M00021964A:C04 |
| M00003759A:E10 | M00001390A:H01 | M00005480C:B12 | M00021967D:E08 |
| M00003762A:D11 | M00001399C:E10 | M00005483D:A12 | M00021977D:E02 |
| M00003763B:D03 | M00001401D:D04 | M00005484A:D09 | M00021978A:F08 |
| M00003763D:F06 | M00001402D:C07 | M00005491B:C03 | M00021982C:F08 |
| M00003765D:E02 | M00001402D:H03 | M00005493B:C08 | M00021983B:B03 |
| M00003766B:G04 | M00001403B:A01 | M00005494D:F11 | M00021983D:B10 |
| M00003767C:F04 | M00001405D:F05 | M00005496C:A01 | M00022005C:G03 |
| M00003769B:A04 | M00001406C:A11 | M00005496D:A10 | M00022032A:E07 |
| M00003769D:G12 | M00001406D:H01 | M00005497B:H07 | M00022049A:A02 |
| M00003770D:C07 | M00001407B:A08 | M00005497C:C07 | M00022049A:D06 |
| M00003771A:G09 | M00001407D:H11 | M00005497C:C12 | M00022054D:C05 |
| M00003771D:A10 | M00001411A:D01 | M00005497C:E03 | M00022064C:H07 |
| M00003773A:C09 | M00001411C:G02 | M00005498B:F08 | M00022067D:C05 |
| M00003773B:E09 | M00001412A:A11 | M00005498C:G05 | M00022068B:H11 |
| M00003773B:G08 | M00001415D:E12 | M00005508B:B04 | M00022068D:D12 |
| M00003773C:G06 | M00001417C:E02 | M00005524C:B01 | M00022069D:G02 |
| M00003773D:C02 | M00001421A:H07 | M00005528C:A10 | M00022071B:D05 |
| M00003789C:E03 | M00001422D:D02 | M00005530B:D03 | M00022071C:D09 |
| M00003790B:F12 | M00001423C:D06 | M00005534B:H10 | M00022075D:F05 |
| M00003793C:D11 | M00001424A:H09 | M00005548B:E03 | M00022081C:G11 |
| M00003796B:C07 | M00001425C:E10 | M00005550B:D09 | M00022084B:F04 |
| M00003797D:H06 | M00001426A:F09 | M00005565C:A08 | M00022085C:C04 |
| M00003801D:F05 | M00001426D:D09 | M00005589C:B03 | M00022090A:G08 |
| M00003805A:G05 | M00001431A:C10 | M00005616B:D05 | M00022093A:A05 |
| M00003808C:D09 | M00001431A:E05 | M00005620C:C05 | M00022093D:B10 |
| M00003809A:A12 | M00001432A:F12 | M00005621A:G10 | M00022094B:G10 |
| M00003809A:H12 | M00001432B:H08 | M00005621D:F01 | M00022106C:F04 |
| M00003813D:A06 | M00001432C:G01 | M00005631A:A11 | M00022110A:E04 |
| M00003818A:F09 | M00001433A:C07 | M00005632C:D06 | M00022114C:B02 |
| M00003818B:A01 | M00001434A:A01 | M00005637B:D12 | M00022117C:G07 |
| M00003819D:G09 | M00001435A:F03 | M00005642B:C03 | M00022128A:D04 |
| M00003821C:E04 | M00001435A:G01 | M00005647D:D09 | M00022139A:C01 |
| M00003822A:G05 | M00001435B:G10 | M00005655B:C02 | M00022149B:D05 |
| M00003825C:B02 | M00001435C:G08 | M00005703A:C08 | M00022150A:H06 |
| M00003825C:B12 | M00001435D:A06 | M00005704A:B11 | M00022153D:D11 |
| M00003833B:A11 | M00001436D:C10 | M00005708D:B03 | M00022157A:F12 |
| M00003834A:A03 | M00001437B:B05 | M00005710A:C08 | M00022157B:A10 |
| M00003835D:H05 | M00001438C:H05 | M00005720A:D03 | M00022169D:C02 |
| M00003839D:G06 | M00001439B:F10 | M00005722C:G03 | M00022170D:H09 |
| M00003841A:E09 | M00001439C:A01 | M00005743B:F02 | M00022175A:A11 |
| M00003841B:D05 | M00001439C:G06 | M00005763B:H09 | M00022176A:E08 |
| M00003843A:B01 | M00001442A:D08 | M00005765C:C04 | M00022178D:H01 |
| M00003844C:D04 | M00001443D:A01 | M00005810C:D04 | M00022183A:G03 |
| M00003844C:H05 | M00001444A:A09 | M00005813D:F06 | M00022189A:A01 |
| M00003846B:H02 | M00001446D:B10 | M00005818C:E08 | M00022198A:C12 |
| M00003850B:D11 | M00001452D:E05 | M00005818C:G01 | M00022199C:F03 |
| M00003852D:D03 | M00001453D:F09 | M00006576D:F11 | M00022202C:F11 |
| M00003859C:B09 | M00001463C:A01 | M00006577B:H12 | M00022206B:G06 |
| M00003868D:F02 | M00001466C:F02 | M00006587A:H08 | M00022212C:C02 |
| M00003868D:F07 | M00001471C:G03 | M00006594A:E08 | M00022216D:C01 |
| M00003871A:E09 | M00001488B:G12 | M00006596D:H04 | M00022218C:B06 |
| M00003884D:A12 | M00001489B:F08 | M00006601C:A07 | M00022218D:B12 |
| M00003887B:C03 | M00001489D:C08 | M00006601C:E06 | M00022220C:F08 |
| M00003888B:A10 | M00001490B:G04 | M00006609A:G10 | M00022221D:E08 |
| M00003888C:E01 | M00001491C:C01 | M00006633C:E11 | M00022226C:B06 |
| M00003890B:H07 | M00001496A:B03 | M00006633D:A06 | M00022226D:A07 |
| M00003890D:C03 | M00001496D:D02 | M00006634B:C02 | M00022231A:F12 |
| M00003892D:D04 | M00001500A:D09 | M00006636A:B08 | M00022231C:A04 |
| M00003893C:D12 | M00001504D:D09 | M00006644A:B11 | M00022236D:A03 |
| M00003895D:A03 | M00001505A:E09 | M00006644D:C02 | M00022239A:A10 |
| M00003896C:F08 | M00001506A:F01 | M00006686A:G12 | M00022239B:B07 |
| M00003896D:B01 | M00001517D:C03 | M00006692B:E04 | M00022239D:A07 |
| M00003903C:H03 | M00001518D:A10 | M00006728D:G10 | M00022252C:E06 |

TABLE 23-continued

Library Deposits

| ES47 | ES48 | ES49 | ES50 |
|---|---|---|---|
| M00003905C:B01 | M00001536B:B11 | M00006733D:G12 | M00022253B:E06 |
| M00003905C:E10 | M00001537B:C12 | M00006734A:H12 | M00022254C:D08 |
| M00003906C:H12 | M00001542B:D10 | M00006735A:H02 | M00022255A:C08 |
| M00003909D:G01 | M00001542C:F06 | M00006764B:D05 | M00022255D:E03 |
| M00003911C:G05 | M00001543A:E04 | M00006765B:H06 | M00022258C:F06 |
| M00003912B:G11 | M00001546B:H01 | M00006785B:F09 | M00022259B:G02 |
| M00003912C:C11 | M00001551D:C12 | M00006791B:B08 | M00022278C:E03 |
| M00003914C:E03 | M00001552B:D01 | M00006796A:C03 | M00022278D:F10 |
| M00003915A:D09 | M00001556D:A11 | M00006800C:G08 | M00022288C:D04 |
| M00003915C:G01 | M00001557C:B08 | M00006814A:F07 | M00022289A:D05 |
| M00003920B:A10 | M00001558B:A12 | M00006819A:D10 | M00022289D:B06 |
| M00003921D:C06 | M00001560C:C01 | M00006820A:G05 | M00022294A:D11 |
| M00003923A:H07 | M00001561B:C10 | M00006821C:C10 | M00022296B:C11 |
| M00003936C:F10 | M00001597C:B03 | M00006822A:D07 | M00022305A:H11 |
| M00003948B:B03 | M00001623B:B01 | M00006823B:D12 | M00022364C:G12 |
| M00003949B:A08 | M00001623D:A09 | M00006826B:H03 | M00022366B:E09 |
| M00003949B:D05 | M00001644D:F09 | M00006828D:C12 | M00022372B:D03 |
| M00003961B:A12 | M00003784C:B09 | M00006832D:F11 | M00022381A:F05 |
| M00003961C:G02 | M00003785D:E01 | M00006846A:B01 | M00022382D:H11 |
| M00003962B:B09 | M00003862C:H10 | M00006850C:D09 | M00022386A:A07 |
| M00003963B:D12 | M00003864B:A04 | M00006850C:G07 | M00022386B:D11 |
| M00003973A:C05 | M00003864D:G05 | M00006851C:H09 | M00022386C:A04 |
| M00003973B:H06 | M00003992C:G01 | M00006863B:E06 | M00022386C:D07 |
| M00003976D:D12 | M00003992D:G01 | M00006866C:F03 | M00022399C:A10 |
| M00003977C:A08 | M00003994C:C11 | M00006867C:E07 | M00022407C:H11 |
| M00003980B:F12 | M00003996C:C04 | M00006868D:E02 | M00022411D:G09 |
| M00003980C:G10 | M00003997D:D07 | M00006870C:H06 | M00022412A:C08 |
| M00003981C:E04 | M00003998A:D03 | M00006873B:G11 | M00022444A:A11 |
| M00003983C:E07 | M00003998C:H10 | M00006875A:A02 | M00022449C:B01 |
| M00003987D:F06 | M00003999C:C12 | M00006877B:E05 | M00022452C:B03 |
| M00004027A:B10 | M00004046A:F04 | M00006879A:H11 | M00022457C:B01 |
| M00004027C:H01 | M00004051C:D02 | M00006882A:D01 | M00022495C:G05 |
| M00004028C:B04 | M00004052C:A08 | M00006901D:A11 | M00022504B:E03 |
| M00004030B:B02 | M00004052C:B05 | M00006907C:D03 | M00022505D:A12 |
| M00004030B:C05 | M00004054B:G02 | M00006907C:C07 | M00022509D:F06 |
| M00004035D:E04 | M00004054D:A03 | M00006912B:E01 | M00022527A:E05 |
| M00004036B:F09 | M00004055B:F06 | M00006921B:E01 | M00022527D:B03 |
| M00004036C:D01 | M00004058B:C11 | M00006960D:E06 | M00022531B:D07 |
| M00004037A:A07 | M00004058C:E08 | M00006963A:H11 | M00022535D:B11 |
| M00004037B:B05 | M00004059A:G09 | M00006966C:B07 | M00022535D:C04 |
| M00004038C:C05 | M00004060C:A02 | M00006972A:F10 | M00022536B:B04 |
| M00004038C:D12 | M00004060D:A07 | M00006973C:E11 | M00022551A:G03 |
| M00004039D:D03 | M00004063C:B11 | M00006973D:E11 | M00022556B:C04 |
| M00004040B:B09 | M00004143A:G12 | M00006974B:F06 | M00022556B:G02 |
| M00004040C:G12 | M00004143A:H07 | M00006976C:E09 | M00022562C:H10 |
| M00004040D:B05 | M00004145C:A03 | M00007014C:B07 | M00022578B:G05 |
| M00004041B:F01 | M00004146A:A07 | M00007015C:G05 | M00022578D:F03 |
| M00004041D:E06 | M00004147A:G03 | M00007016C:E06 | M00022583B:E05 |
| M00004043D:C10 | M00004149B:H12 | M00007041B:G01 | M00022587C:G04 |
| M00004069D:G02 | M00004153D:E06 | M00007042A:E07 | M00022594B:H12 |
| M00004071A:H03 | M00004154D:F11 | M00007043A:B05 | M00022598A:F11 |
| M00004073D:B11 | M00004159A:C04 | M00007046A:D02 | M00022599D:E07 |
| M00004076D:B03 | M00004166B:E10 | M00007047B:D01 | M00022604B:C11 |
| M00004081C:A01 | M00004166C:A03 | M00007051D:D09 | M00022607B:A04 |
| M00004084C:G04 | M00004166D:G07 | M00007053B:H03 | M00022613D:C04 |
| M00004085B:G06 | M00004196C:G05 | M00007058A:C02 | M00022651C:C06 |
| M00004087C:F05 | M00004234B:E03 | M00007062A:D03 | M00022666C:H11 |
| M00004091A:E01 | M00004234B:G06 | M00007099A:F09 | M00022681C:H02 |
| M00004091B:C12 | M00004236D:E07 | M00007100C:D01 | M00022682A:F12 |
| M00004091B:G04 | M00004236D:F04 | M00007112B:C06 | M00022698C:E06 |
| M00004091C:F04 | M00004240D:A07 | M00007105D:C07 | M00022701B:B12 |
| M00004091D:D09 | M00004242C:C02 | M00007121A:A05 | M00022708C:A08 |
| M00004092A:C03 | M00004244B:A02 | M00007122B:G11 | M00022708D:G10 |
| M00004092A:D04 | M00004245A:G09 | M00007122B:A11 | M00022725C:E09 |
| M00004093D:D09 | M00004245C:A03 | M00007127B:A04 | M00022726A:A06 |
| M00004101D:A03 | M00004247A:E01 | M00007129A:G10 | M00022730A:E04 |
| M00004103B:C07 | M00004247B:C11 | M00007130B:B03 | M00022737A:C08 |
| M00004107C:A01 | M00004248A:G08 | M00007132B:G08 | M00022763A:E10 |
| M00004114C:F02 | M00004263D:F06 | M00007134C:F07 | M00022824C:H11 |
| M00004115A:F01 | M00004272D:D02 | M00007137D:C10 | M00022835C:E06 |
| M00004117B:F01 | M00004273D:E11 | M00007140D:C12 | M00022854D:H07 |
| M00004120A:C02 | M00004277D:C08 | M00007150C:C09 | M00022856A:D02 |
| M00004126B:G02 | M00004281B:B05 | M00007150A:H06 | M00022856B:F04 |
| M00004129A:H08 | M00004283C:D03 | M00007154A:E04 | M00022856C:B11 |
| M00004130C:A09 | M00004285B:E01 | M00007163A:F11 | M00022893C:H11 |

TABLE 23-continued

Library Deposits

| ES47 | ES48 | ES49 | ES50 |
|---|---|---|---|
| M00004133D:A01 | M00004297D:E08 | M00007163B:A12 | M00022897A:F04 |
| M00004178B:F06 | M00004298D:D04 | M00007166B:E06 | M00022900D:E08 |
| M00004180B:F04 | M00004308A:E06 | M00007170D:A10 | M00022900D:G03 |
| M00004184B:F11 | M00004324B:D09 | M00007172A:A05 | |
| M00004191B:G01 | M00004328A:H06 | M00007172C:C08 | |
| M00004193A:C07 | M00004329C:F11 | M00007188A:D03 | |
| M00004193C:H01 | M00004331D:H08 | M00007189D:A09 | |
| M00004199D:C02 | M00004332C:E09 | M00007193D:A04 | |
| M00004200A:A09 | M00004337D:G08 | M00007195B:B02 | |
| M00004200A:G06 | M00004345A:H06 | M00007198C:A10 | |
| M00004200D:A07 | M00004383A:F02 | M00007199D:B07 | |
| M00004201D:C11 | M00004385C:B11 | M00007204C:F09 | |
| M00004201D:E12 | M00004388C:D05 | M00007929D:H10 | |
| M00004202B:A02 | M00004406A:H03 | M00007961A:B01 | |
| M00004204A:D04 | M00004408D:A10 | M00007964B:D10 | |
| M00004204A:D10 | M00004410A:E03 | M00007971A:B04 | |
| M00004204B:A04 | M00004412B:E03 | M00007977C:E08 | |
| M00004210A:B09 | M00004421A:G04 | M00007995D:E06 | |
| M00004216D:E10 | M00004447D:D10 | M00008074D:C01 | |
| M00004217A:A11 | M00004460B:H09 | M00008094A:E10 | |
| | M00004465C:B10 | M00021611D:D05 | |
| | M00004465C:B12 | M00021611D:H03 | |
| | M00004467A:F09 | M00021614B:G12 | |
| | M00004467D:F09 | M00021618D:D07 | |
| | M00004491D:D07 | M00021624A:D07 | |
| | M00004497C:E09 | M00021624B:A03 | |
| | M00004501A:G06 | M00021625A:C07 | |
| | M00004506C:H10 | M00021629D:D05 | |

TABLE 24

Library Deposits

| ES51 | ES52 | ES53 | ES54 |
|---|---|---|---|
| M00001448A:D05 | M00001439B:E02 | M00006621A:G10 | M00021640A:G03 |
| M00001458B:F06 | M00001443A:E02 | M00006626A:G11 | M00021657B:C08 |
| M00001530A:D11 | M00001443D:C03 | M00006629D:D04 | M00021690B:B06 |
| M00001563C:D06 | M00001444A:G12 | M00006630B:H06 | M00021690C:B07 |
| M00001564C:D04 | M00001445B:E03 | M00006631B:B02 | M00022071C:C09 |
| M00001569B:F04 | M00001451B:H11 | M00006631D:C04 | M00022081C:B11 |
| M00001575A:H02 | M00001452B:F09 | M00006631D:E09 | M00022085C:A07 |
| M00001589C:D12 | M00001488B:H02 | M00006635C:B10 | M00022091B:B07 |
| M00001589D:G10 | M00001491B:E07 | M00006636A:E06 | M00022122D:D06 |
| M00001590A:A07 | M00001496C:H10 | M00006636D:A05 | M00022150D:D11 |
| M00001598C:D10 | M00001499A:D01 | M00006636D:F11 | M00022154A:C01 |
| M00001599A:H09 | M00001499A:D05 | M00006640A:B01 | M00022170D:H07 |
| M00001609A:B12 | M00001499B:H05 | M00006640A:F05 | M00022365A:A01 |
| M00001614C:G04 | M00001500B:H07 | M00006640D:H08 | M00022389B:H04 |
| M00001626C:C10 | M00001504C:H11 | M00006641A:B03 | M00022439A:E07 |
| M00001634C:E12 | M00001506D:A11 | M00006643A:E10 | M00022449D:F06 |
| M00001639A:A04 | M00001543A:D03 | M00006644C:E09 | M00022458B:E06 |
| M00001640A:F02 | M00001543A:F01 | M00006648C:E04 | M00022474A:H09 |
| M00001640A:F04 | M00001548C:A09 | M00006650A:B11 | M00022480B:E07 |
| M00001647C:C07 | M00001555D:F11 | M00006656C:C10 | M00022489C:A08 |
| M00001649B:E08 | M00001557B:D10 | M00006664B:B04 | M00022490C:A08 |
| M00001654D:F06 | M00001597A:C07 | M00006664D:H09 | M00022490C:C01 |
| M00001658B:C07 | M00001604B:D09 | M00006665A:F07 | M00022493C:B07 |
| M00001659D:G08 | M00001605D:G01 | M00006665B:D10 | M00022493C:C06 |
| M00001663C:C03 | M00001621B:B09 | M00006674B:F04 | M00022498C:C08 |
| M00001675C:B03 | M00001622C:F06 | M00006676B:F11 | M00022514A:D04 |
| M00001677A:A06 | M00001624A:A09 | M00006676D:D11 | M00022515D:C04 |
| M00001677A:A12 | M00001640D:C10 | M00006679C:D07 | M00022549B:G07 |
| M00001678D:A12 | M00001645B:C09 | M00006681C:G04 | M00022557B:A08 |
| M00001679C:F03 | M00003782D:F04 | M00006695B:F08 | M00022565C:H02 |
| M00001681A:H09 | M00003783C:A06 | M00006698B:E06 | M00022578D:A08 |
| M00001687C:A06 | M00003786D:C06 | M00006699B:C07 | M00022597B:F11 |
| M00001693D:F07 | M00003787B:B07 | M00006705B:D02 | M00022599A:C03 |
| M00003746B:E12 | M00003787D:A06 | M00006712B:H10 | M00022661B:E11 |
| M00003766A:G09 | M00003864C:D09 | M00006717A:D04 | M00022661D:H01 |
| M00003795A:B01 | M00003993D:E12 | M00006721C:G07 | M00022666B:E12 |
| M00003796C:H03 | M00003997B:H04 | M00006725A:A03 | M00022674D:G04 |

TABLE 24-continued

Library Deposits

| ES51 | ES52 | ES53 | ES54 |
|---|---|---|---|
| M00003797D:E10 | M00003997D:G11 | M00006725A:B03 | M00022718D:G05 |
| M00003799B:D02 | M00004047D:G09 | M00006727B:G08 | M00022725C:B03 |
| M00003809B:D08 | M00004048D:A07 | M00006728C:B06 | M00022727B:C05 |
| M00003811B:E07 | M00004049D:G04 | M00006737C:A08 | M00022728A:A09 |
| M00003812B:F08 | M00004050A:F02 | M00006738A:E05 | M00022730D:E10 |
| M00003812D:E08 | M00004051C:D10 | M00006739B:B10 | M00022735B:B01 |
| M00003815C:A06 | M00004058B:F12 | M00006739B:B12 | M00022745A:B04 |
| M00003815D:D01 | M00004060C:A11 | M00006739C:H07 | M00022856B:D07 |
| M00003816C:F10 | M00004064A:B12 | M00006743B:G12 | M00022901D:C09 |
| M00003818C:E09 | M00004066A:E12 | M00006744C:C06 | M00022902D:D03 |
| M00003819A:B09 | M00004067C:D08 | M00006745D:E08 | M00022953B:C07 |
| M00003819C:E04 | M00004134A:F08 | M00006751A:F03 | M00022960D:E08 |
| M00003820A:H04 | M00004134A:H04 | M00006758D:C01 | M00022963A:D11 |
| M00003820D:E02 | M00004134C:B11 | M00006760D:G12 | M00022968A:F02 |
| M00003824B:D06 | M00004140B:B01 | M00006763B:B11 | M00022980B:E11 |
| M00003825B:D12 | M00004143C:F08 | M00006769D:A04 | M00022980C:A09 |
| M00003826B:D01 | M00004144D:B06 | M00006770B:C05 | M00022993A:F02 |
| M00003829A:E02 | M00004152C:E01 | M00006771A:E06 | M00023003C:A03 |
| M00003832B:G03 | M00004159D:H07 | M00006771A:H07 | M00023011A:A06 |
| M00003833D:D06 | M00004160A:A01 | M00006771A:A09 | M00023021A:H08 |
| M00003835A:E03 | M00004161B:A12 | M00006771B:F03 | M00023023A:B12 |
| M00003837C:F05 | M00004163A:D11 | M00006774D:C01 | M00023028A:A02 |
| M00003839C:B05 | M00004164D:D02 | M00006777B:D10 | M00023033A:E10 |
| M00003845A:A05 | M00004165C:E09 | M00006779B:A11 | M00023034C:E05 |
| M00003846D:C12 | M00004166A:F02 | M00006779D:D03 | M00023036D:C04 |
| M00003857C:A03 | M00004167C:F10 | M00006780A:H12 | M00023094A:C04 |
| M00003858A:D01 | M00004169A:B11 | M00006789C:F04 | M00023103A:E11 |
| M00003860B:A07 | M00004200B:B04 | M00006790D:A05 | M00006754B:D05 |
| M00003868B:C07 | M00004222A:H10 | M00006796A:H10 | |
| M00003881D:D09 | M00004223D:D07 | M00006797B:D12 | |
| M00003883D:C03 | M00004225D:F01 | M00006801A:G05 | |
| M00003884B:E06 | M00004228C:D11 | M00006805A:E11 | |
| M00003886C:D10 | M00004229C:G11 | M00006805A:H09 | |
| M00003903C:A12 | M00004239C:A07 | M00006805B:C04 | |
| M00003912C:H01 | M00004239C:C09 | M00006807D:D08 | |
| M00003915B:G07 | M00004240D:E06 | M00006813A:C04 | |
| M00003920D:D09 | M00004241B:B01 | M00006822D:D05 | |
| M00003926B:E03 | M00004243C:E10 | M00006825C:D06 | |
| M00003934D:F01 | M00004266A:F10 | M00006831B:B04 | |
| M00003958C:C10 | M00004266B:H06 | M00006832A:F05 | |
| M00003965A:F07 | M00004268C:F08 | M00006832D:F10 | |
| M00003972C:F02 | M00004268D:G07 | M00006833B:E11 | |
| M00003974B:A04 | M00004269A:B11 | M00006872B:G01 | |
| M00003974C:A05 | M00004269D:E08 | M00006875D:D10 | |
| M00003975B:H09 | M00004276C:E12 | M00006879D:A10 | |
| M00003976C:C05 | M00004277B:C06 | M00006882D:F03 | |
| M00003980C:A11 | M00004277C:H11 | M00006884D:D06 | |
| M00003987A:C07 | M00004279D:E02 | M00006908C:A05 | |
| M00003988B:C10 | M00004281B:B03 | M00006921B:C02 | |
| M00003988C:A06 | M00004284B:F07 | M00006921B:E03 | |
| M00003989C:F01 | M00004287B:B12 | M00006949B:F03 | |
| M00004028C:D01 | M00004287C:B06 | M00006960A:G11 | |
| M00004029A:E01 | M00004297D:B08 | M00006966D:G03 | |
| M00004030A:E09 | M00004332B:D02 | M00006974B:D06 | |
| M00004031A:G05 | M00004332D:E11 | M00007013B:F02 | |
| M00004032D:D03 | M00004346D:B06 | M00007014C:C05 | |
| M00004033C:D10 | M00004389C:E01 | M00007014D:D04 | |
| M00004034A:E08 | M00004403A:B05 | M00007030A:G01 | |
| M00004035A:A10 | M00004407D:B09 | M00007030C:F08 | |
| M00004035B:H11 | M00004419D:G01 | M00007053B:C07 | |
| M00004035D:C05 | M00004449D:H01 | M00007065B:B12 | |
| M00004037B:A09 | M00004463C:F11 | M00007065D:C01 | |
| M00004037C:C05 | M00004466A:E09 | M00007075C:D08 | |
| M00004037D:B05 | M00004469A:C12 | M00007085A:B07 | |
| M00004044A:F08 | M00004470C:A02 | M00007118C:G02 | |
| M00004068A:F02 | M00004498B:E01 | M00007119B:H10 | |
| M00004068B:D04 | M00004509A:H02 | M00004824C:G09 | |
| M00004068D:B01 | M00004605C:A09 | M00004826A:E09 | |
| M00004069B:B01 | M00004609C:C11 | M00004839C:B01 | |
| M00004073D:E01 | M00001378B:F06 | M00004840C:F02 | |
| M00004075A:G10 | M00005294C:G08 | M00004840A:H05 | |
| M00004075C:C09 | M00005294D:H02 | M00004845D:E11 | |
| M00004076A:E02 | M00005330C:F09 | M00004846A:D02 | |
| M00004077D:D10 | M00005333C:C08 | M00004846D:H09 | |
| M00004078A:F03 | M00005342B:G10 | M00004854A:C09 | |

TABLE 24-continued

Library Deposits

| ES51 | ES52 | ES53 | ES54 |
|---|---|---|---|
| M00004078C:A08 | M00005352C:G09 | M00004858D:E06 | |
| M00004084A:D11 | M00005352D:E06 | M00004999A:F01 | |
| M00004086A:A03 | M00005353B:B09 | M00004999B:D12 | |
| M00004086D:A07 | M00005359B:G01 | M00004999D:E01 | |
| M00004088A:F12 | M00005359D:H08 | M00005004B:C11 | |
| M00004089A:F02 | M00005377A:A04 | M00005005C:E06 | |
| M00004089A:G03 | M00005377A:D05 | M00005009B:A02 | |
| M00004093A:F03 | M00005385C:D08 | M00005015D:D11 | |
| M00004097C:A03 | M00005388A:F07 | M00005457D:C08 | |
| M00004102B:B04 | M00005388D:B11 | M00005519B:H04 | |
| M00004102C:F07 | M00005392C:C04 | M00005519C:F08 | |
| M00004103B:C09 | M00005393A:E11 | M00005531B:A03 | |
| M00004103C:F11 | M00005394A:G07 | M00005535B:F06 | |
| M00004104A:H09 | M00005396B:C04 | M00005587B:H02 | |
| M00004104D:C09 | M00005399B:F02 | M00005685A:A04 | |
| M00004108A:D04 | M00005400A:D02 | M00005706D:A09 | |
| M00004109B:A01 | M00005403A:E11 | M00005711A:H01 | |
| M00004126D:B11 | M00005406B:B08 | M00005798B:C11 | |
| M00004133C:B02 | M00005411D:E05 | M00005799C:C12 | |
| M00004182D:H03 | M00005415D:G02 | M00005805D:E06 | |
| M00004183A:D06 | M00005417C:E10 | M00005827B:H08 | |
| M00004186B:E05 | M00005419A:D05 | M00005828D:C09 | |
| M00004187C:H09 | M00005419C:D09 | M00005837A:D12 | |
| M00004188A:E05 | M00005443D:C12 | M00006751B:B11 | |
| M00004188A:E10 | M00005447B:D02 | M00006754B:D05 | |
| M00004190A:C12 | M00005448D:E08 | M00006756B:B08 | |
| M00004190C:G07 | M00005450A:A02 | M00006757D:E04 | |
| M00004190D:A10 | M00005450A:B10 | M00006758A:B12 | |
| M00004190D:G12 | M00005450D:C04 | M00006758D:C04 | |
| M00004198D:H04 | M00005451A:E03 | M00006834A:C08 | |
| M00004202B:F04 | M00005456B:B07 | M00006835B:F04 | |
| M00004202B:G09 | M00005456B:E03 | M00006837C:G06 | |
| M00004206C:G11 | M00005460A:B10 | M00006841D:A08 | |
| M00004213A:H12 | M00005465C:H02 | M00006855C:H02 | |
| M00004214A:D03 | M00005466A:F12 | M00006855D:H02 | |
| M00004218D:F12 | M00005468B:D04 | M00006859A:F06 | |
| M00004249C:E12 | M00005470B:E01 | M00006860B:H01 | |
| M00004249D:G02 | M00005473D:E10 | M00006886A:D06 | |
| M00004252D:A07 | M00005483A:F05 | M00006893C:B02 | |
| M00004253D:F09 | M00005483D:A02 | M00006893C:F02 | |
| M00004257C:A08 | M00005487A:H01 | M00006895D:E10 | |
| M00004262C:C01 | M00005489A:F06 | M00006917C:E07 | |
| M00001339B:E05 | M00005493B:A12 | M00006919B:C03 | |
| M00001341A:A11 | M00005493B:E01 | M00006923C:B01 | |
| M00001346A:B09 | M00005497C:C10 | M00006926A:H11 | |
| M00001346B:A07 | M00005505A:C08 | M00006934A:G02 | |
| M00001346B:G03 | M00005508A:H01 | M00006936B:E09 | |
| M00001346C:B07 | M00005510B:D06 | M00006936B:F10 | |
| M00001348A:G04 | M00005528D:H06 | M00006937B:F07 | |
| M00001348D:H08 | M00005534A:G06 | M00006937B:G09 | |
| M00001352C:E01 | M00005539D:G07 | M00006939B:E05 | |
| M00001362B:H09 | M00005571A:E11 | M00006953D:H11 | |
| M00001370A:B01 | M00005619C:H10 | M00006980A:F02 | |
| M00001370B:D04 | M00005625D:C03 | M00006986C:G11 | |
| M00001374C:C09 | M00005626A:B11 | M00006989B:C11 | |
| M00001376A:H02 | M00005635B:A06 | M00006990B:H09 | |
| M00001378B:F06 | M00005635C:F11 | M00006991A:E07 | |
| M00001380C:D10 | M00005636C:D11 | M00006991D:G07 | |
| M00001383C:C07 | M00005637D:C05 | M00006995C:A02 | |
| M00001384A:C09 | M00005641B:E02 | M00006997B:E06 | |
| M00001391D:A07 | M00005645D:F08 | M00006997D:B03 | |
| M00001391D:A09 | M00005646C:B09 | M00007006D:D04 | |
| M00001396C:G02 | M00005646D:B03 | M00007010B:C11 | |
| M00001397A:F10 | M00005655D:C04 | M00007010B:H03 | |
| M00001397B:E02 | M00005703C:B01 | M00007012B:D07 | |
| M00001397B:H11 | M00005720B:D09 | M00007031C:D01 | |
| M00001399D:F01 | M00005722A:E09 | M00007032A:F11 | |
| M00001400D:B08 | M00005762D:A01 | M00007033A:H05 | |
| M00001402C:E09 | M00005783A:C05 | M00007033D:F04 | |
| M00001406A:G12 | M00005812C:F10 | M00007036A:D02 | |
| M00001406D:B06 | M00006581C:D02 | M00007037B:D04 | |
| M00001408A:B02 | M00006581D:H08 | M00007084B:A05 | |
| M00001409C:D01 | M00006582A:B09 | M00007093A:F09 | |
| M00001411C:F02 | M00006582D:E05 | M00007099C:F09 | |

TABLE 24-continued

Library Deposits

| ES51 | ES52 | ES53 | ES54 |
|---|---|---|---|
| M00001411D:C01 | M00006592A:D03 | M00007101A:A11 | |
| M00001412D:C03 | M00006594D:F09 | M00007107A:D11 | |
| M00001417B:C07 | M00006596A:F07 | M00007121C:H01 | |
| M00001417C:A09 | M00006601D:F04 | M00007129A:E04 | |
| M00001418A:C02 | M00006604C:H10 | M00007132B:B11 | |
| M00001421C:A03 | M00006607B:E03 | M00007134B:G07 | |
| M00001426A:C02 | M00006607B:F04 | M00007146D:G01 | |
| M00001427A:C05 | M00006615D:F04 | M00007148B:C06 | |
| M00001433A:F04 | M00006616C:H09 | M00007160C:B08 | |
| M00001434C:D05 | M00006616D:C08 | M00007161A:H03 | |
| M00001435C:H05 | M00006617B:D09 | M00007192C:H08 | |
| M00001438A:H10 | M00006619B:C11 | M00007200B:C02 | |
| M00001438B:H06 | | M00021619B:G10 | |

SEQUENCE LISTING (2707 sequences)

SEQ ID NO: 1 - DNA, 264 bp, Homo sapiens
  misc_feature (1)...(264): n = A,T,C or G
gttcatccataatgtagcatgtatcagaagttcatttctttttatggctgaacaagattccattgtgtgattagattgcattttctttatccgtctgttgatggacgtttggggttgtnccacncttntgccngagntcgaaacnnnctnanananctatgctgtggncncntgccnatntctncanctcaanngnnncagnctgtacncnntnntgaananncngncanncancnacnngctannnntatannacnntncntc

SEQ ID NO: 2 - DNA, 266 bp, Homo sapiens
  misc_feature (1)...(266): n = A,T,C or G
gtctcgctctgtcgcccaggttggagtgcagtggcgcaatctcggctcactgcaagctccgcctcccgggttcacgccattctcctgcctcagcctcctgagtagctgggactacaggcccctgccnatctaattctttggntaaannttntcnntcttgnatctccatngccatgatnttataaatttgntttcnnanttattnccttntttttcnngganantannggnttngctttttanntgattcngntnnttcannanag

SEQ ID NO: 3 - DNA, 300 bp, Homo sapiens
  misc_feature (1)...(300): n = A,T,C or G
ctaatcataggcacaacatctcagactacatcggatttcagataaggttagtactgatgctaaggtctaattttttaacttttattaatgaataccttttttaaaataggtttttgtgtcattatggttatttgcctagtttgatactcaaaacatgactcttagtctaacttanngntgtttaaacctgagtancncncagaccccttttnanggnnaacnnanttctcntggatcccagctgttgtcnttttgtnggncnctntntntnatngnctngtntantncaacntctgctcg

SEQ ID NO: 4 - DNA, 288 bp, Homo sapiens
  misc_feature (1)...(288): n = A,T,C or G
gcttgatttgtggcttgaagtttgaaaggaagtgcctgtttgttcagggaacaccaattggactaacagctgacctctgtattaaggccatctttagcttgtcttgcatatactttccttgttcactaatcccttctccccaccctgcttcctttagacccatgttaatctattacctnngagcngctctagattctagagttgncantgactaatntcncngannctctnattctgttgagcttaatngnctctcnaatttnntactgatgttccnttnttagactt

SEQ ID NO: 5 - DNA, 292 bp, Homo sapiens
  misc_feature (1)...(292): n = A,T,C or G
atctccttctccgggaattcaagtaaggcatgtctacaccccctctacgacaaagcatttctcacccataagacagtcaacgacttnanncnangancacagaggnnatgnggtcggcncncagagtgcatgttggcgcgtgcgtgntagnatctcgnaggtgttgcngccangagttanccagagtcaatgccnnacacatagtatgagaagagcactttntaagagntnaattnatttgagnnnangtattttngnntntgtanttggcncgcttttttnaangctataa

SEQ ID NO: 6 - DNA, 287 bp, Homo sapiens
  misc_feature (1)...(287): n = A,T,C or G
cagcaactcaggaggctgaggaaggagaatcacttgaacccgggaggtggaggttgcagtgagccgagatcgccccactgtactccagcctgggtgacagagcaagactctgtctcaaaaaaaaaaaaannnccnnngnaaanttttnngnannggataanttnggttncngggtnggaaatnantnntancnggnaagggnaaaaaaagggnggttanttnggnggttttnnaanaccccaaatnaaaaagggnnggttttacccnggnaaangnnaatgttcaaa

SEQ ID NO: 7 - DNA, 294 bp, Homo sapiens
  misc_feature (1)...(294): n = A,T,C or G
tctggccaatgtggtgaaacttctgctctactaaaaatgcaaaaattagccgggtgtggtggcacatgactgtagtcccagctactcaggagactgaggcaggagaatcactcaaacctgggaggtggaggttgtagtgagcngncatcangcccnttncactncannctatgntaccnnnctgaanntgtctcatnnaactaatncataaatnnanaccgtnncntactgtgttnnccanactgctctcanntntctggacntcacnntcctctctctaacctcctcctccca

SEQ ID NO: 8 - DNA, 289 bp, Homo sapiens
  misc_feature (1)...(289): n = A,T,C or G
gaaagattgtggccagatgtgcatgggcttgctgtctagttgttgttttcantngatagtggggnttgccnaaanctttgnaacagcttacntaatattactnttnttttatnnnngntgctnatgntttnanctncnttgtcaaaangnaggcatgtttacnanantaantnancnttttganancncctatgctgtttnngngagattctgcttnaacccntgataccttcntggnncntnannnttatnctgacttctttttacagacactnntgttcacacactt

SEQ ID NO: 9 - DNA, 276 bp, Homo sapiens
  misc_feature (1)...(276): n = A,T,C or G
ttttttgtatttttagtagagacgggttttcaccgtgttagccaggatggtctcaatctcttgacctcgtgatacgcccgccttggcctcccaaagtgctgggattacaggtgtgggccaccacacccagccttttttttttttttttttgnaaanaaagggncnaattttnnccaaaanccnnggnngnaggnnngggcccaantnngggntaatngaancntcnncntccagggtncnnggntttttangncctaacccncngnngaaccggga

SEQ ID NO: 10 - DNA, 285 bp, Homo sapiens
  misc_feature (1)...(285): n = A,T,C or G
gaatcacttgaaccccagaggcagaggctgaagtgagccaagattacgtcactgcattccagcctgggtgacagagcgagactccatctcaaaaaaaaaaaaaaaaaaaaaannngnnccttnaaaattnntngggggcnttntttcnaangnnaaaccntttatntncccttngnggnnngggnnnanccngnnntnnaangganggnaaaaannggntttttngaaaantttggnnantntttnttttttttnnanccnttntaaggcntnggnnaaaaggtt

SEQ ID NO: 11 - DNA, 288 bp, Homo sapiens
  misc_feature (1)...(288): n = A,T,C or G
ggtggctcatgcctgtagtcccagctattcaggaggctgaggcatgagaatcgcttgaacctgggagtagaggttgcagtgagctgaaattgcaccactgaactctagcctgggcaacagagtgagacttggtctcaaaaaaaattaaaaataaaaaataaattgggggctgagtgtggtgntnangntntanttntcnnttcttangnancttgnatnttttnaaatntcgnntttnngtntnnnttnntttttttnatnnatntagntnttntnntcgnttttttt

SEQ ID NO: 12 - DNA, 299 bp, Homo sapiens
  misc_feature (1)...(299): n = A,T,C or G
ggagaccgcctgggaatactcgggaggctaaggcaggagaatcgcttgaacctgacggggtggaggttgcagtgagccgagatcgcgccacttcactccagcctgggcgaaagagcgaaactccatctcaaaaaaaaaaagggaanttnaaaannaccngcaaatgtntngttngggaanntttntgnagggtngngnccnttnggncctttacntaaccccnggantncntttaagggnaanggnggtnaaggntgttnaancncngggngtncntgtntaaaanangtttggttccc

SEQ ID NO: 13 - DNA, 300 bp, Homo sapiens
ggaaagccctttgtcatgaatctgcaggatctgtatatggcagtcaccacacaagaggtccaagtgggacagaagcatcaaggcgctggagatcctcatacctcaaacagtgcttccctgcaaggaatcgatagccaatgtgtaaaccagccagaacaactggtctcctcagccccaaccctctcagcacctgagaaagagtccacgggtacttcaggccctctgcagagacctcagctgtcaaaggtcaagaggaagaagccaaggggtctcttcagttaatctgttgtggcctcagct

SEQ ID NO: 14 - DNA, 270 bp, Homo sapiens
  misc_feature (1)...(270): n = A,T,C or G
gccttatgtcttgggagcctgttttgctaggcaaagttacaagtgacctaatgggagctcaaatgtgtgtgtgtctctctgtgtgtttgtgtgtgtgtgtgcactcaagacctctaacagcctcgaagcctggggtggcatcccngccttgccattaacatgcctcatgcatnatcagatgacaaggacaaccctnatgacnaatcaacatgaattagggggcctcttgntcttggtccaaaattgtcantcagnnatgancatatagga

SEQ ID NO: 15 - DNA, 300 bp, Homo sapiens
  misc_feature (1)...(300): n = A,T,C or G
tataagattactttcatgttggatagtgctgctatgataacagtacatactccaaggagaggattaatagacgtaaagcctcttggtgttatatggggaaagttttcggagttttacagcacgaaaancaccattatgttngatgacatagggagaaattttctaatgaacccacnaatggactaaagattaggncntttnttnangcnccccttnattnnnntnancccnccnacnttttaaatccnctnanntnccttcaggngatngcccanttagatgactttttggatctaaatc

SEQ ID NO: 16 - DNA, 300 bp, Homo sapiens
ctttttatagtggtggctggcaagaaggaagcagttctccacgttctcacctaagcccagagcaaggaacaggtataataagtggaaaatcttggaataagtataattatcatccagcctcccagaagaatactcaacaacccttggccaagcatgaaccaaggaaagagtccattaaaaagaccaaacatttgagattgtcacagccttctgaagttactcattataagtcaagcaaacgagaagtacgaacatctgattcttccagccatgtttcccagtctgaagaacaagcacaga

SEQ ID NO: 17 - DNA, 249 bp, Homo sapiens
  misc_feature (1)...(249): n = A,T,C or G
gtttcttgtaagtactctgggagtgcataatacattttaaataagattaaaaattatgttttattcttactagcatcactgtcagataattgagcgtgagagcattcagtgctgtgtgcttggtacgaagnagtaacatnaatttagagttnagtnntccantttgnatcntcngcaanngcatctntgancnntgcgccngtganntnnnnttatgnnantatctnatntnnnnngnanngcnnaaac

SEQ ID NO: 18 - DNA, 300 bp, Homo sapiens
ggatgctgagatgatagtccttttgaccaggatgtctcaagtatccaagcccagaaatcatctcttctaggctgaatcaagatggtttgcataagagaccatgcagatgcacgtctctgctatcttacattaaaaatgcagaatggctcacctgccctttgttgtcatatgttatatagaaaaacctatttgcatgagaactgtcacccacagttttgggtagggtcagtgtgtgccactgagcaggaacgccgagggccataacctgtctaatgtattaaattctcaggaatcgggatt

SEQ ID NO: 19 - DNA, 300 bp, Homo sapiens
cgctggtgtcaggagtattttcatattccaataccgataaatctttgaggtgattttggttgatcacgattggggtttctgtggagccagtaatagggggtgtcgaggttgcctgtggagttagtgattgcggtttcaggcttcggtgatggggttctgtggcgtccgttgttgattgtgacggatttctcaggtttctgggtgtctctggggagcccctgggccagattttcctctagactccagcccatctcttcagagcagctctgcttgagttcacagatgactgccaagcttcag

SEQ ID NO: 20 - DNA, 300 bp, Homo sapiens
acatggtgagttatgcatatctgaaaatgaaagaaggcttgtttctaaagaggcttggagcaaactgcagcagtactttccaaaggctcctgagtttccaagttacaaagagtgctgttcacagtgcaagattttagaaagagaaggggaagaaaatgaagccttacataagatgattgcaaacgagcaaaagacttctctcccaaatttgttccaggataaaaacagaccgtgtctcagtaactggccagaggatacggatgtcctctacatcgtgtctcagttctttgtataagagtg

SEQ ID NO: 21 - DNA, 300 bp, Homo sapiens
ctaattgggttgttttctagacttaggaatcaccagggaaaggctaagcttagagaggactgtggattgagccctcatctctttttaatctcctctataacctggcagattctattggcttttcattatgagattgtactgcaaatgaaagaaagaggaggtggggtgttctgggcttggttacagctgggtgtttatcacaggcatttataagaagttagtacactttcaggccctctgacaggaagctttgtaacctggcattcatgtcatgccagcattaagtttagagaaatgctc

SEQ ID NO: 22 - DNA, 290 bp, Homo sapiens
  misc_feature (1)...(290): n = A,T,C or G
cagcaactcaggaggctgaggaaggagaatcacttgaacccgggaggtggaggttgcagtgagccgagatcgccccactgtactccagcctgggtgacagagcaagactctgtctcaaaaaaaaaaaaangncccnnggaaanttttgnggannggntnagttnggntncngggtnggnanttantnntancnggcaagggcaaaaaaagngnggttanttaggnggntttncaccnccccaantgaaaaatgggnggttttaccccggggaaatgganatntcacagat

SEQ ID NO: 23 - DNA, 300 bp, Homo sapiens
gttgcaaagcttgggactggaaattgttttgttcttgaaacaaaatacttctttaaggttgcttttgctgtttgactgctgtctacattcgtaaaattctattttgtgaattggtagctaaatcccttactaccctgacaccgtggtatctactgtatttcttttcaaggtgcaatttgcttcagagttccagtcagctagattaagcaagaggctccagaagaaatgtttacttgaattttgcgcttcctttcttgatagtttcctatataaaatttgtcattgaacaagagcaaatgc

SEQ ID NO: 24 - DNA, 272 bp, Homo sapiens
  misc_feature (1)...(272): n = A,T,C or G
acaaaacctcgtcattaaagacaaatttatcagaagatgggtgcacaaagaaggctttagtggctccaagaggtatgtgactcgctgccgangncntngtncttgnttnccgngntngtactncctnttgccntttntgnccnttnntttctntnnttngtgtnnctngtgnncnttgtggngnttttnnnggcttgcttntttntgagntttnntctttnttntntattcntttcncnntgtntgtnntnttgntntnttntgttttncta

SEQ ID NO: 25 - DNA, 300 bp, Homo sapiens
tggaaactatgtccctgcacccaaagaaggttcttttgaactttatggagaccgagtcctgaaactgggaactaacatgtacagcgtgaatcagcctgtggaaactcatgtgtctggatcatcaaagaacttagcctcatggacccaggaaagcattgctccaaaccctcttgctaaagaagagctgaatttcttggccaggctgatgggagggatggagattaagaaacccagtggccctgagcccggattccggttgaatctctttaccaccgatgaagaagaggaacaagcagcgct

SEQ ID NO: 26 - DNA, 300 bp, Homo sapiens
gccagcatgaaaaccaggaaaactgcttttaactttcaagttagtgaatatccaaggaggatatacctgccctatccctaaactgagctgatgaggctctgatagggttcaaggttgtgtgacttctagttctgattccaacccaatagggccatctcacagccccatctctgcatattagtttctccggttggacccttaggctgaaacattgctatcttcctcctgtacatgcagcaggcctgttttttggctaaagaaagtaatgaaaggttcagtttagaaatgacaggccaggcg

SEQ ID NO: 27 - DNA, 300 bp, Homo sapiens
  misc_feature (1)...(300): n = A,T,C or G
cacaagctatataaaaccttctagaatgtcctttttgcagtaactggtgtcactgcaattttaagactgaaatattagaggataaaactagtgacatgaaaaaaatagccttggtgacttgtgcatcttttgtggagccggaaggtaatttttttaatttcacgcactcgctttccttctggagagtctgaaaggttgctgagatattagcactgatccttaatgccacctcagagagctttgggatcaggcggcactttgacaggcgatcacagngttgnaaatnaggcactccaggga

SEQ ID NO: 28 - DNA, 262 bp, Homo sapiens
  misc_feature (1)...(262): n = A,T,C or G
gggctttgaagatagctttgaggaagaagaggaggaagaagaagatgatgactaagcagtactctgaatggaccacagtgtttgcacatatttgcaattttttgctgntttggaagngtatcataaaccagantcagnacagaactgatgntgagggaggggnacgntctcttttgtattttatttnncncnntnnnntgttctngnctgnnnntncnatcnctntngnntttnncctntaatnnanntttttgtnnnnntc

SEQ ID NO: 29 - DNA, 300 bp, Homo sapiens
ctcgcgcaatgggctgcctgtggacatcaccaaggtgccgcctgcccctgtcaacaaggacgactttgccctggtccagcggcctggcccgggtctgtctcaggaggccgcccggcgctatggtgaactcaccaagctcatacggcagcagcacgagatgtgcctgaaccactcaaaccaattcacccagctgggcaacatcactgaaaccaccaagtttgaaaagttggcggaggactgtaagcggagcatggacattctgaagcaagccttcgtccggggtctccccacgcccaccgc

SEQ ID NO: 30 - DNA, 297 bp, Homo sapiens
  misc_feature (1)...(297): n = A,T,C or G
aggatcaggaagtttgtgctctctgcgtggctaagtttttcacctactaggacgggggaggtgtgggaggttttggtgtncttctaagatacnnnacnagnttcnnnctgnttcccaccntaacccagaatnnctatattatcaggcgcnnatgaccactttaacttaccgngnccgangtactgnaattnnccatanctntgaacnnannatnnnttgtgaggattacagcacttgcgagatgantnccactgctgaaanattcttngngactctantgttatnccctttaccctt

SEQ ID NO: 31 - DNA, 300 bp, Homo sapiens
  misc_feature (1)...(300): n = A,T,C or G
gcaaggtgcagtagctcacgcctgtaatcccagcactttggaggccgagacaggaggattgctttagaccaggagttcaggaccagcctggccaacacagtgaggccctgtctacaaaaaattaaaataatcacttagaaaaatcaaatattcttgaaaaagtttagacttgcaaatataatatggggaaaatggacangcnaccnattnactctagttcnaaaataccaagccgactgnctnncattaagttnnagaagcnnaagnagganttaacagctccatgangactnttgatga

SEQ ID NO: 32 - DNA, 282 bp, Homo sapiens
  misc_feature (1)...(282): n = A,T,C or G
tagaagaaacacacagaacaagcagcctgacatgtaacagagcaggaagcccccccatgtccacctctacctcattttgtcaagtcttcaagagacctccaggcccagtcactgtgaattcattcctctgggtttaggcactcacctccccgccaccccagagaggtagcatattaaatcattaacagaatctaatataanggggccctgtgattactgggaacncgttcttctgaattatatgcgngnganccntantncntgnngnangnnctttaaagg

SEQ ID NO: 33 - DNA, 296 bp, Homo sapiens
  misc_feature (1)...(296): n = A,T,C or G
aggccttttccccacttcttaaccttcactgagagggtggttggggtctgtttcactccatgtgtcctagatcctgtgctacagaccttcctttctgtcctcccgtcttggacctcagtcctgggggctccaaagtgctgttcgtgcaggtagtgtgattacccaacctactgctganctanccatttcccgnccccccgggacacgttctctctgccaatngncttcttgnctgagctccccaagctccatctgtcatgctgngnagcccanntggcgttcanaatnggtctggt

SEQ ID NO: 34 - DNA, 261 bp, Homo sapiens
  misc_feature (1)...(261): n = A,T,C or G
gctacagccattacagtcaactagatttgagtgctgccgctggtaagttaattgaatagccaagttatgttgtccttacccaagtagacagtggaaaggaataatggcanaggccatgatgcgagtntggccncanccatgcatnccntctgtngtgntcttagttctgtnatactctatgttttangttanttacctaaatcatntntgaatcangnntnattttncnttntatgtatcnnanngtntanttttntngtt

SEQ ID NO: 35 - DNA, 300 bp, Homo sapiens
ttcaaatttctgtgcccttctctcctctccttggttctctcccatgttttgtcaaacttcccacacccagctccttaaacaaagggactggctaggtcaggcagaggttgagtcaagagtgctcaggtgtcccaggatgactgtcaagagtggtggcagctctcctatgtctcagccccccaggagcacctcagccctgcaacggcatcaaactgggtggcacacactagtatggagccagaaatcagtcagtgggaatatgatgcacccaattttacagtgactgtgtcctgaaactcc

SEQ ID NO: 36 - DNA, 261 bp, Homo sapiens
  misc_feature (1)...(261): n = A,T,C or G
gcctacactagtgaattaatctgaaaggcactgtgtcagtggcatggcttgtatgcttgtcctgtggtgacagtttgggacattctgtnttcatgaggactcacagtcgaccntcatgttactttctttgnnnnactctnttnccttgnntgactgcntgctngatnttntntcntnncncaaangtngccnnntttagtnntncgttagagatncangngnnggntnnctgttaaatntcgnnnnnncttnnncanattc

SEQ ID NO: 37 - DNA, 300 bp, Homo sapiens
catgtggtgcacaggtcggatggtaaatttcagatctttgcctatagagggaaagttcctgtggttgtgagttacagacctgccaggggagtcctgcagccagacaccctgtccattgctagccatgcatcattaccaaatatatggaccgcatggcaagccataacccccttggtggaggaactgaatgtcctacttcaggaatggcctggactgcactacaccgtgcacattctctgttctaagtgccttaagagaggatcgcccaatccacatgcttttccagggaaatctgctgtg

SEQ ID NO: 38 - DNA, 300 bp, Homo sapiens
aaaatgagagtattttcttttctcccttcatttacctgggtgttttggctcaccaaagagttgtgttctgcaaatgtctgggcaatccatggagctaaactggcattagagtcaagtaacactcctcctctctccctgttcttttccttaaaatcttcaaaggcattgggggttttaccttagcaacttgctatttcgtcttcttagtttgaaccttcaaatatagctggatataataaaatgctcctcaaatgaggaagtaccagaaagaccagatgcatggtctcatgcttcccttgt

SEQ ID NO: 39 - DNA, 300 bp, Homo sapiens
cttcagcatacaccctcagggagtcacagccttccaacgtccattcatggagcccaggtccaaaacctgtgatccgagaataggataacccttttctgcccatagggtgttttccaaagacctttcattgctctgggttacgtgggaaacaacaaaacagaaccatcccccgcactggtcagctgctacgggtcacgccagggaaaagtgtggactgatgtatttcgttgtttaccatgtttctagccagagctaatttgaaaataggtatcccaagaaccagactgcaggagtatccca

SEQ ID NO: 40 - DNA, 300 bp, Homo sapiens
gaggaactccccaggcattctgtgagatggtagtgttcacagcgctgacagatgtccctttgacacagtcctggggtcttctctgcacaacagaaaggagttttgtgacaaagttgatggaggaggttaggtatttaattaggactagccagggagggcagggactctgttaagcagtgaatttgtcaaaattttacttgtaccaggtgggaagataactagctgtggaagcctgttctgagatgccctgccatggccaatgactggttaaccacaagggtcactaaaagagagggtttc

SEQ ID NO: 41 - DNA, 298 bp, Homo sapiens
  misc_feature (1)...(298): n = A,T,C or G
ggaacctcacctgtggctcagctcaccccacatccgtttctcattacgtgtaaataaactgtcagagctgatgttacagcttttacagtttaaagcattcccctcgtctctagttccttttttnttgnttacatagtntnggcactttccctgattcacnanctttcngggnngangagnggagnaggnggggcgtnatcnggtgnattnnggngngnnngnngtgggaaggntntggcgngnngcngntatntgggagngtgggnagtggtagggntntantnngtgacntggattg

SEQ ID NO: 42 - DNA, 298 bp, Homo sapiens
  misc_feature (1)...(298): n = A,T,C or G
gcttgttctggggaaagctcatataagtatggattttattcctcaactagtaggataccaatactggtattgaaacttggggaaaataactggagataccagtgcagctatttaaagctgtagcaagggctgcaatcttgcggagattttaaagagaagttttaaagtttctaatactgatgcctctttttggtaaatacaagttttataaatcctgccctgggatcctgattccccattaatcaagatttgtcagacttcaccttctataattagaaaacacngttataagaacagt

SEQ ID NO: 43 - DNA, 300 bp, Homo sapiens
  misc_feature (1)...(300): n = A,T,C or G
cttgaacctaggaggtggaggttgcattcaactgagatcataccacttcattccagcctgggtgacagagcaagactctgtctcaaaaaaaaaaaggaaaactntgnganggacatttgttnagtaaanccnttcagtattnatccntcctttccccncagcagctttntttcctgtcaactaaaanggaccaggangtaataaatncnttttggngggactaggccacnccaantntnaatcntctcccntttnccttanacatttaaattgcaaggcgggnccctctggngctcaaaa

SEQ ID NO: 44 - DNA, 163 bp, Homo sapiens
ccgggccagggtaacagaatcaaccctgccctgccctgcctgagcctggcaccagatcacaagcaacagaagtcttctgccagctgaaaagctgagtgtgggacagcagcactgaggaagccctgacaccctagtccccactctaagcagcccaccactagag

SEQ ID NO: 45 - DNA, 277 bp, Homo sapiens
  misc_feature (1)...(277): n = A,T,C or G
ctcaggcagggagaaaaggaggcagtgggcacagccgtggactatggctacttcagattcttccaggaccggaggattgcccgctgtcccttccacacgctgatgccancagagcgcgagacgctcctgncnccggaannctctcttggngtnantgnntnttgcttctatttttantngnnnnannnctnttggttggnccctatttttcncncngcctcnnggnancttttttttacnnngttntctnctncngnnccaatnnnntttccttttt

SEQ ID NO: 46 - DNA, 293 bp, Homo sapiens
  misc_feature (1)...(293): n = A,T,C or G
gaagagcttctgcaggggctgagcagaccccagggcctcttagccaatccccgggcctggtgaagcaggcgaagcagatggtcggaggccagcaactacctgcacttgccgccaagagtgggcaatcttttaggtctctcgggaangccccagntttcctccccantgatganatgatnatgtnncttntnanntgcnttgtnttatntntnncttntatttnntatcttnttttcnantttntttttttgnttccgtnctnnnttnttntnggngnttntcttnnttgttgt

SEQ ID NO: 47 - DNA, 258 bp, Homo sapiens
  misc_feature (1)...(258): n = A,T,C or G
tttctaatatgattacatgagtctactttataaactggtataggctatgtaattagcccgtaagttacttaaaggaccaggggacctaatttttgtcagttttccagtcacattggtgccattcaggactccagctgtttacaggaaatatgtacttatcanaatagtatttttccttgaggnatnncangatntttgcctcattaccacttgggnattattngntngcaagnnngntaancngcannnccattgcta

SEQ ID NO: 48 - DNA, 271 bp, Homo sapiens
  misc_feature (1)...(271): n = A,T,C or G
gagagagagggcctgctggagagcatagggtctggaacaccaggctgaggtcctgatcagcttcaaggagtatgcagggagctgggcttccagaaaatgaacacagcagttctgcagaggacnggaggctggnagctntnagggcttnntgctntntagatttcntatncncntcnnttctntnttttacctttntttctactncttnnttttttnttttntgctnntntntnnntttntnnttnncccnnttntttctntncntcatctt

SEQ ID NO: 49 - DNA, 291 bp, Homo sapiens
  misc_feature (1)...(291): n = A,T,C or G
aattcggcctctctagagtcttccccaggccactccttcacactccttactagcagcccctgcttagcctccacactacggcctggtgacctggtccatggtgctcgccctggtgcttgaagcctggnaagcgnccanggctgtggttcnnggatgtngcttnagntaanangnnggtaacccgggaannnaattnanantnnanaagnggggggctttnnttntattnccnaaccntntnctttanccntannntttggcngntgnaaaaggtattcnnantncctttcc

SEQ ID NO: 50 - DNA, 300 bp, Homo sapiens
gagttctacaggtggagtgtggggcccagaaggggctcaggtcttaggggtgtcatctgaaaaaacagagatggtgatgggacaccagttctaggagccctctgcatggccactttctgcctcagctcttctaaagcatttcttctgttcccttccattggggtaaccactgatctgtcttcccaaaaactgagtcagaagttggactttgttacttggctcatctacatttaagatatagtcagaaaaaaaatgcagtctttacatcttaagaaagcttacatgggccaggcgcagtgg

SEQ ID NO: 51 - DNA, 300 bp, Homo sapiens
  misc_feature (1)...(300): n = A,T,C or G
gttgttgttaccgtgtgccaatgtgtcccatgtgggttgtgccaggtagagaaacaggaagtcaatcatctgtgacagtctctattctgtcgttttgctccttggtatttgatttgcactatatttacntganncctgttcactgtttaaaaccngaggncatcttnanaggcattggagacctggcttcnnaatgntgtcccancantnctgnctnaanctcctgntcatntcccnttnntgnngtgnnccannacnnttattttnaattngtatnntaatntanacntgtttctcccc

SEQ ID NO: 52 - DNA, 294 bp, Homo sapiens
  misc_feature (1)...(294): n = A,T,C or G
agaacacaaaacttgaaagaagttttatgcgtgtgacagtgtatggggctgcagttggtctccctggaggggacttccacacctcctgcctttaggccatgggtggaangtgctcnttgttgtctcctttnttcccttttgtngcgntntgnnnntnttgntttnntnttttagtttntgttttcttctnnttntntngancttnngtttntntnnnnncttttttctngcntgtngnntntctttngtnnatattnnnnnnngttgcntnttgggntcgtctnntnttttcta

SEQ ID NO: 53 - DNA, 165 bp, Homo sapiens
gtggcttttatcatgcatgacaaacccctggctttcctgccagatggtaggacatggaccttgacctgggaaagccattactcttgtgtctgctactgccctcccacagtcaccccaatattacaagcactgccccagcggcttgattttccctctgccttcctt

SEQ ID NO: 54 - DNA, 300 bp, Homo sapiens
ctttgggacagtgtgagtggagcttgtgtccagttgtgcacacggacacccggaaacctctcattaggagaagccactgctgcgcaccctggagatgggttttgaccctgggctcccgttaatgttgttgtggctccagatgcctcagaaataacttccagagtcaacaccatctgcggaagtgccgtgagacggtgcatgggctggagacagagacagccggcgccgaacatacctggggctgcccgtgcaaactggggcaagcccttcagcctccatgtggctgctttactatggaga

SEQ ID NO: 55 - DNA, 264 bp, Homo sapiens
  misc_feature (1)...(264): n = A,T,C or G
ctgtgactggctgagctgctgtggccgggctgggcagtgtgccccaacagctcagtgctttcctgacactccagtgtctggggtggttgaggagcgagtactctcttncttccanaccaagttcctncctngggtttgccttganacgtnttatgnttttnnancntattnntctnnnntatnantttttanatnntntntnncttattanantnnattttnttantatntatagnnntatnnnntnttnaanatatnatnata

SEQ ID NO: 56 - DNA, 300 bp, Homo sapiens
  misc_feature (1)...(300): n = A,T,C or G
ccccagattcccaatcccaccgcaatgtttggcaagcctaggactgataagtagctctgatagaggagctggtggcttttatacttcttcctgggtttttgttggggtttgttgtttcgttgttttttgtttttttttttgttnggttgggnaagnattgnnttnnacgngngctattttcagtaccanagtaancncaaggtttnaatcnagttgcataaaacacctttgcatagctattnaatngcccaangtaaaactttaangccatttcnaangctttaattcatttttgaagta

SEQ ID NO: 57 - DNA, 278 bp, Homo sapiens
  misc_feature (1)...(278): n = A,T,C or G
gtgtcccaagtgtccggagcaggcggcagaggcctcagtgcggcaaacacaggcccagagcctgtgtggcaccagcagcatcttagagccccaggtatatgctgagatcttatctcacgctgtctccagttgtctgttgngacnaanngntgnnnctantncnnnacaccttnnnantttgtatnnttgcnttnnntntntncnncttnantctnngtttnaccngntatgctnngnnnttntnttacttnannganatagtccacattcgctactct

SEQ ID NO: 58 - DNA, 300 bp, Homo sapiens
  misc_feature (1)...(300): n = A,T,C or G
gctaagccttacacacttgtcctgtgcctttgttgtcgtatccctatgtaaataccttctccaccttcccattccttcatggatgacttcccagaccttcccactcatcttttgaatgtgtttattgctgacttggcaatgcatcaaaatctttttttttttnggccncnggnntaacngnntnacagggggaannccccnngaaancgnaaaactnttngcanctnangtcnnnccngnatnttcanggncagggatnattggtggcnanagttttnangncnntaangancctttaag

SEQ ID NO: 59 - DNA, 262 bp, Homo sapiens
  misc_feature (1)...(262): n = A,T,C or G
aaaaagaagccagtaaaagatcctgagatggattggtttgctgatatgatcccagaaattaagccttctgctgcttttcttatattacctgaactgaggacagaaatggtcccaaaaaaggatgatgtctccccagtgntgcagtttttctcactatttnctgcttantntannntactgngggngangcttantgctggntttantgagngntantattnctgnttntttgcgncntgnntnnnanttnttttcagtttcc

SEQ ID NO: 60 - DNA, 274 bp, Homo sapiens
  misc_feature (1)...(274): n = A,T,C or G
aaccggacggacttgcccatcggccctcacgacacgcgtgcagtgggactctagccaaggcggtggccgagccatcattacaatttttctggagtaaaggatccacggtgggacatcaactggcacttactctgtttaggaacttgagttgaatcatttctaaacttgtcctttagaccacgcctagggcagcaaattccacttcctagaactgcaaaccgggagaggatgtagntagattntggcatnctgccccggctctttgagggaaaag

SEQ ID NO: 61 - DNA, 268 bp, Homo sapiens
  misc_feature (1)...(268): n = A,T,C or G
gaaggatctccttggttaccaaagacactcacatctttaattttggtgtttcgatggaagcacaggatataattctctgcctccttaaattgttgaacgtgctgcaaagtttgacatttagaaatagaactagggctgtggggctttgttccgctttagcggctttgttctntgtcnttgcnnnctcacttnngtgcntngagntcagnnnatattatacannantgnnnnnncnnanncnttangcagtnttgcagggngcgacact

SEQ ID NO: 62 - DNA, 289 bp, Homo sapiens
  misc_feature (1)...(289): n = A,T,C or G
ggagaccgtcactccaggtgcattctggaagcattagaccccaggatggagcgaccagcatgtcatccatgtggaatcttggtggctttgaggacattctggaaaatgccactgaccagtgtgaacaaaagggatgtgttatggggctggaggtgtgattaggtaggagggaaactgttggaccgactnntgccccntgctcancactgancnctctgantgnttnnangcttnnttnnttnnatacnntatnncnattnncnntttttnnntntttntttnttttttt

SEQ ID NO: 63 - DNA, 270 bp, Homo sapiens
  misc_feature (1)...(270): n = A,T,C or G
aacactttctaccacactgtgggaagcatcgataaacagtcataataattatcattctgagtcactgcaagcgtggggttggatgctggctctcacagtatcctgtgtagggaccatgagcagccatgcgcncctncangcacggncgagctcaaccngaagancnngcgtgctccctggcaggagcaggatgcctgaccacagantgataattattatnacnggtatngnngcttgccacagngtggnngaaaggnntgaatttcactt

SEQ ID NO: 64 - DNA, 291 bp, Homo sapiens
  misc_feature (1)...(291): n = A,T,C or G
gaataagggaaggtttggagtcctgggtgattgcttgggatgccagcagcatttgagaccaaacaggggtgtgaagatgggtgggtcagctcaccttgcagagtgtagcataaatgggcacagccagaaaattgcttcttcctccaaagctctctgattcaggaatttggggcntattgtggaacgttatnacattcttgtctctgngcttactnttcccgccattcattacgaacnannagtttnnaacgnngttctgntntcaaagncantgcatctnnttatcatact

SEQ ID NO: 65 - DNA, 300 bp, Homo sapiens
  misc_feature (1)...(300): n = A,T,C or G
attgtgttgagatccaccgctcacacgccgtacaccacccagtggcttcattctggcttagccgcagaggcaagaaagggaccccacttgctcccatgcccacctcaagaaaaaacataaaacaattttttttaaaaaagaaaagaaatctacctcagttgacaggattcnacctttanggtntcttnntcttttnngttntngcngncttntctnnttttcttntnatattctttnnnnttntntnntttnntgcnntnnnncttgnnttnntnnttnnngcttcntcntttttatttt

SEQ ID NO: 66 - DNA, 300 bp, Homo sapiens
gcctttttctccgacgaccaggagccctaccctgtgactgatatttcggacctgatccgggattcctatgagaaatttggagaccagtctgtggagcagatcgagcacctacgttacaagcacaggatcagggtcctccaaggccacgaggacaccacaaagcagaacgtgcttcgagtcgttatcccggaagtctcaattcttcctgaagacctagaggagctctacgacttattcaagagagaacatatgatgagctgttactgggagcagcccaggcccatggcctcacgccacgac

SEQ ID NO: 67 - DNA, 300 bp, Homo sapiens
atcatgctgctagtgttcccgctactagtgctccgttagttttaaatcatgttccaacttgaatttgaggtcttttgactttcgttggctttttgtcagggaaaaaaacctgttagggacagggtttcacaattccttttatatttccattcacatgtatttacaaacgtgtgcctggagtagtaagtacacaataagtgagtttccagctgtttttgtttcggaaacaaaaaaaacaaaacaaaacaaaacaaaaaaacaacggaaggtgaatggaattgtgtttgtaacattaaactg

SEQ ID NO: 68 - DNA, 300 bp, Homo sapiens
ggcagacttctcatccgtaaaatcaggaagataacatgattccaagggcgttcatgaggattaaaggaagtcatgctcctaatttactgcctggcacacagacagtaaaatgctcaatacatttatggaaggaatgaaggactctggcagaaaaacaggtcagatgtgtctgctgtggacaggtggctctgtcggtgcccggtgagtgccctgggagtctggcagtcacctcctccgcagccgtgtccccaggctcacaggagccacctcaggtgggaagctctctgccagccttggaag

SEQ ID NO: 69 - DNA, 255 bp, Homo sapiens
gctgcagcaaaaccagagaatttcctcaagtggcctgtaggctccttgttatcttatgcccccacccctccctcaacaatatgagtgatccagaactggcccaaacacctcagctctggtccctttttgcccttcttggccttactctgttgttcaaagccactttggattgcttggatgcttcgaacagccatgaaaagtagcctgcctgtggcatttagaggccaagcaattgacagaaagggtttcttctac

SEQ ID NO: 70 - DNA, 300 bp, Homo sapiens
attgtgcacctctaaccctctctagcaaccttattgataccattcagtgccaatattcttccaaccaggttgaggacttttgatttgctgagaatgaaattctgcatatctttgcttgtcactaatgcctgtctgctctctgcctcaccttcttgtccattggtatatgtttggcactctgagagtatacagcatcaattcattcatatctccaatactctttcattaagtctcagttgcttgccagcacagacaaggtactgcccaaagaagtccttggaaaacaggcaagatatatac

SEQ ID NO: 71 - DNA, 300 bp, Homo sapiens
agatagtgaaggacctagaggcttcccaccagcacagtagccctaatgagcaattgaagaaaccagtaaccgtgtccaaaggcacagcaactgagcctctcatgctaatgtctgtgttttgccaaacagagagttttccagcagaaagaacccatgggagcaacatagccaagatgacaaacactgggctgcctggtcctgccactcctgcttactcatatgcaaaaaccaatggccattgtgacccagagatacaaactaccagggagctgactgcaggcaacaatgtagaaaaccaag

SEQ ID NO: 72 - DNA, 261 bp, Homo sapiens
  misc_feature (1)...(261): n = A,T,C or G
ggcaaaaggcatctgctggagctggtgaccccagcttggtgccccccaaagccagagtacgaggctgagaggatgcaggtgtcctcctaggaggtttgagtcagaaggcacgaggcagaagcagtgggggaggactccctcagtagagcgaggaggaggcccctcatccaagaggaggttggagcacaggggggtctaggtttgcagtttcnggaccggnagctnangngtcccanggcctttnttntgtttnganaattt

SEQ ID NO: 73 - DNA, 300 bp, Homo sapiens
  misc_feature (1)...(300): n = A,T,C or G
gtgcccccagccagggtgagcccctttcccagaactgcctcaccacccagcccttgtgtgatcctcatgtctcctgccccaggaccacatcctgagcttgggtgccgacttcaccttgatctccctcggcagcatcaggagaaagtggagcggntgttanaggtgtcangtgaannttncttgngntttcttgntncttnncntattatttttngttantatncntngnntntttaantntntttttantnttnnntntttnttntttnttctnntttattgtntnntattnnttttttt

SEQ ID NO: 74 - DNA, 300 bp, Homo sapiens
agacgttgcagcaagtggacaagtggccgctgtgcgggcccctcgcttgtagtgagctgttgcagcttacggtccgttccctggagggggggaggagtgagaggttgtgcagcatcaaaggtgctgggacatcccagggtggtgagatccatccacgatccagctccggtggagaaagggcccatgtcaagccttgttctgcaccccaagcattggtggtaggactgggtcctggctgatcgtccttgttcccagtggggtacatgtgagcccctgccagggccaagtccttctcccgaa

SEQ ID NO: 75 - DNA, 247 bp, Homo sapiens
ccgtgcctcgctttccctgtcccccgccctatggacacccctggctcaggccagtgtgcttgtcccagcatcgcgctcatctcctgtttttatttgatgttacagatttcatttcattaggaatgagtgtttcctccccgacttttgcctgcattattttgccagctcctccctggaaaagggcaggggcggacactttcccagcctcccaccgtgctctgttcctagtggcacctgccccagggtc

SEQ ID NO: 76 - DNA, 300 bp, Homo sapiens
  misc_feature (1)...(300): n = A,T,C or G
tgcttggcttcggggctgaccgccggtcccctttcttctcaccacagtgcccatttttcatccagggagaacctcggggctgggacacctcctggccctcaccctgggtcatgtttacagtcctcagtgccccacaccggtggccccctgaggacacctccaccctgaccttgattttcccaaacgctgcctcttggtgacagactcagcccaaaaccccttccttctgtctctggagacccttgagcttggggaaatatggaaggngtgtgtgtctgcaatcaaggcctctgcagctca

SEQ ID NO: 77 - DNA, 292 bp, Homo sapiens
  misc_feature (1)...(292): n = A,T,C or G
gcctgcataaggtttgattactcaggagttggaagttcagatggtaactcagaggaaagcacactggggaaatggagaaaagatgttctttctataattgatgacttagctgatgggccacagattcttgttggatctagccttggagggtggcttatgcttcatgctgcaattgcacgaccagagaaggtcgtggctcttattggtgtagctacagctgcagataccttagtgacaaagtttaatcagcttcctgttgagctatnaanggaagtcatatgnnaggtgtgtg

SEQ ID NO: 78 - DNA, 277 bp, Homo sapiens
  misc_feature (1)...(277): n = A,T,C or G
gctttgcaaaccacatacattattatcacttacagtctgcagaactactgaattccaagctgcctcggtggcaggagacctgtgttgatgccatcaaagtgccagagaaaatcatgaatatgatcgaagaaataaagaccccagcctctacccccgtgtctgnaactcctcaggcttacccatgatcgagagaagcnntgtggtttggntngaanncgactcgnnntcattgctnagggngngaggcgtttcgnnnttaggcttaagntattgtggg

SEQ ID NO: 79 - DNA, 300 bp, Homo sapiens
  misc_feature (1)...(300): n = A,T,C or G
gccaaggctgtactgcggatgctcctgctgctctggttcaaggctggcctccagacttcaccccctatcgttccactggacagagagacccaggcacagcccccggatggtgaccacagccctggcaaccatgagcagtcctacgtggggaagcggtcaaaccgggtggtgcgaaccctccagaacacgccgtccctgcactccaggcactggggagctccccagnancgggagggacnncagcancagnatnncgannngctnagtgcgancnncacccncttggngctgcaggatacc

SEQ ID NO: 80 - DNA, 300 bp, Homo sapiens
gagcgacgaacttctgagacaggtgtgggtgcgagggtcggtagggtcatgggattgggaccgaggtgtgaggagggaatctgcaattccttgctacacagagcgctggcaacttctgacaggctgtttctggggtatgggctgcctcgggttgttgctgttacaaggaaagaaaagagttcccctgcccaccgcctcccagccactgggctacctcctggcaggaaatttgcaaactgagtttaacaagttaggatcagcagagggtagaggagggccctggcagatgtggggtctaga

SEQ ID NO: 81 - DNA, 300 bp, Homo sapiens
aattcggcgcggtgagtggtgagactgccttgggcgggttaccgggcatgactcttcgtgacgattctgagacccccccttccccccgaactcctccagcccgcagagttctatctccaggtggaccgcttcagcctgctgcccacggagcagccccggctacgggtgcctggttggtaagtgatgcctccgcccaggagccctgctctgtctgggtgagcatagcccctctgcagctggagggtagaacaaggaaggcctgaggtagagctgggagggagcatgggtagccttggatgg

SEQ ID NO: 82 - DNA, 300 bp, Homo sapiens
ggaggatgttggcaagcaggtgtggcggggcgccctgctcctggcagactacatcctgttccgacaggacctcttccgaggatgtacagcgctggagctcggggccggcacggggctcgctagcatcatcgcagccaccatggcacggaccgtttattgtacagatgtcggtgcagatctcttgtccatgtgccagcgaaacattgccctcaacagccacctggctgccactggaggtggtatagttagggtcaaagaactggactggctgaaggacgacctctgcacagatcccaaggt

SEQ ID NO: 83 - DNA, 300 bp, Homo sapiens
aggcgcggtgccccagagtggggtgcctgcactctcagcttccacaccctcaccctacccctacatcggacacccccaagtatgtagggtgggcagaagccacagtcgccgccgccaggggcttgctcctggctctgtcctttgcttccctccgtcctcgctcagttgtgatccagcagcccccctccccactgcctccccagctctcagtgaccccgactgtctcctgacttagccgagcccccgagacaccttgaggaggccgctccttcccagacacacccccacgcccccactgga

SEQ ID NO: 84 - DNA, 300 bp, Homo sapiens
  misc_feature (1)...(300): n = A,T,C or G
gtgacttctgctatccatgttgaggttgcagaacttgaagctaatttaccttgtacatgtaaagtgcattttcctgatccaaacaagcttcattgttttcagctaacagtaaccccagatgagggttactaccanggtggaatatttcnttttganncttttnttcnntanagtatncatnttatncntncnaatctncattnctganctanttanatnncacttnaatacnttcncttganncntctcttnnnnnnntnnttctnntnnnnccttntantanatcnntttatatctctc

SEQ ID NO: 85 - DNA, 300 bp, Homo sapiens
cgtagaggtttgagaaatgacttgaagagtcatgtgtgttggcacgtttatggccttcttcagaggtcagacaagaagtatgatgaagccattaagtgttacagaaatgcactaaaatgggataaagacaatcttcaaatcttaagggacctttccttactacagattcaaatgcgagatcttgagggttacagggaaacgaggtatcagttacttcagcttcgacctgcgcagagagcatcatggattggttatgctattgcttaccatttattagaagattatgaaatggcagcaaag

SEQ ID NO: 86 - DNA, 300 bp, Homo sapiens
ctacggtttcccgtcaccaattttccttggaattggacagatggcagccaccataatgatactatatgtgtccaagctaaacaaaatcattcacttccctgattttgataagaaaattcctgtaaagctgtttcctctgcctctcctctacgttggaaaccacataagtggattatcaagcacaagtaaattaagcctaccgatgttcaccgtgctcaggaaattcaccattccacttaccttacttctggaaaccatcatacttgggtgattttggttttcctccattcttccagtgtg

SEQ ID NO: 87 - DNA, 295 bp, Homo sapiens
  misc_feature (1)...(295): n = A,T,C or G
tggaggaagcagcagggaaaacctggcgctgcaaaatgtgcaggctcgaatacggatggtcctcgcctatctgtttgctcagttgagcctctggtctcggggtgtccacggtgggctcctcgtgctgggatccgccaacgtggatgagagtctcctgggctacctgaccaagtacgactgctccagtgcggacatcaaccccataggcgggatnancangacggacctcanggccttcgtacagttctgcatccagcgcttccancttcctgccctgctgagtttctgttggacc

SEQ ID NO: 88 - DNA, 300 bp, Homo sapiens
atccaccgtcattccccaataccttagttgtagtcaactaactagataggctgccgaagatggtttaactgtgtccagcttaactacagccaggctttggaatgcctggcctatgtctgtaaatgaaatctaacaatttattgtataacgttgttaaacatgaagcatgatgttggccctggataaaacattttaaattctcgtcgttcataccagaggctcagtaactgaccggttgaaagaaaactgttcattgtaacctaatgatgctagttagatagcattagattatgttagaga

SEQ ID NO: 89 - DNA, 300 bp, Homo sapiens
  misc_feature (1)...(300): n = A,T,C or G
gccttttgttgtgaagttgctcatcatttaggagtgtttaattctaaaaagccttcagcctaagaaagcttcatctgtggggaccagagacttgttgctcagggagttagtgatgggacttgggcatctgatctgcaggtgacaagtttagttcaactgaagttgtagggaatttagacagttgcacatcattgccgttctaggggccttgtagaaagatgaaacagttgtttttcatttaccagcacctctcagttatanaggtnatggaacnttcncttactttgnatcatcattcct

SEQ ID NO: 90 - DNA, 300 bp, Homo sapiens
acctttacctgcaacctggctgagaatgtgtccagcaaagttcgtcagcttgacctggccaagaaccgcctctatcaggccattcagagagctgatgacatcttggacctgaagttctgcatggatggagttcagactgctttgaggagtgaagattatgagcaggctgcagcacatattcatcgctacttgtgcctggacaagtcggtcattgagctcagccgacagggcaaagaggggagcatgattgatgccaacctgaaattgctgcaggaagctgagcaacgtctcaaagccatt

SEQ ID NO: 91 - DNA, 300 bp, Homo sapiens
ggatcctccaggctgccggctgggaaggcgtgggcgacccggtgtgtggcgcgcccagagccccgcgtttcagccctagggaaggaagccagttgagggaagttctccatgaatgtacgtcacaatgatgatgaccgaccaaattcctctggaactgccaccattgctgaacggagaggtagccatgatgccccacttggtgaatggagatgcagctcagcaggttattctcgttcaagttaatccaggtgagactttcacaataagagcagaggatggaacacttcagtgcattcaaga

SEQ ID NO: 92 - DNA, 300 bp, Homo sapiens
ataagcagtggctttcaaaccgtgtgctctaggactggctgggccttggagaggcgtcagtggcgccctggggaaacagggcaccagagcaatgggtgaggtccagcctgtcctgctcacgtcagccagggcacatccaagtctgttgtcagttgactgttgggttcctggattagagtttgtgagggacgagggaggtttttaaacccacacaaacacagcatttattttactgcagatactgtttgaagtgctgtattagttcgttttcacgttgctgataaagacataccagagcct

SEQ ID NO: 93 - DNA, 300 bp, Homo sapiens
ccctttgagatttctggctttttgtagggacctcagttccattttcccaactcatgggttctcaataccttaactatcttttatttgtcaaattccaagtcctcaactcacccaccactacctgacccactgcagtcaccacaccaccctacccactttcccagggatgctttatgattagcttaaatactcaccattctgatttgtaatgccgcccccaccccctttttttgacacctgggagtttccttttctttcttgtaagatcagcattacacaaacaagcacatttttcttatt

SEQ ID NO: 94 - DNA, 300 bp, Homo sapiens
gctgcatctgcaatgaggatgccaccctacgctgcgctggctgcgatggggacctcttctgtgcccgctgcttccggtgggtgcaggtggaatgttctgtgcgagagctcaagggctgcctggatccctgacttgtatccctttgttccacagagagggccatgatgcctttgagcttaaagagcaccagacatctgcctactctcctccacgtgcaggccaagagcactgaagacaccctggtcctcccggaagggcagtcccacaggcagcggcacccatttctgggccccgccacag

SEQ ID NO: 95 - DNA, 300 bp, Homo sapiens
gtgaggaaagaaatagtcagtaaattgatgcgatccctaaaaagggcagcattgcagcgcccaggcataagacgtgtgattgaagatccggaagataaagaaagtagactaatcatgttggatccctataaaatatttactcatgattcctttgagaaagcagaactcagtgttttagagcagcttaatgtcagtccacagatctctaaatacaatttggaactaacatatgaacactttaagtcagaagaaatcttgagagctgtgcttcctgaaggtcaagatgtaacttcagggttt

SEQ ID NO: 96 - DNA, 300 bp, Homo sapiens
gcttagataagtcaaatgcagtagacaatggatagtcatcacagatttttgtacatgggacttcacataccttaattgaatatccatcgtgtacaaaatattgctcaagcaatgtaggaatcaagggaataaaagcttattctgatattatagagcatataacagccatgtaaatatgcatggtatagagaaatcagttctatgatggatgtaccagcaaagttgcagagcattatatagagttgcttttgatatgagccctagaataaattgggatagagagggagttggggaatttga

SEQ ID NO: 97 - DNA, 286 bp, Homo sapiens
  misc_feature (1)...(286): n = A,T,C or G
ttttcttggagacattccagattgccatattactttattttaaacagcgctatgactttaaatccaaggctgctcggaagatttttttaggtctctcataagcctattcttccctgatcacatgagtgggagaggtaagcctnattttgaangccctttctgngnnnnnanannttcnnnnccannnntntnnngaagantntttnngngtnnncanttgccattnttccntgnnncnnnnnngnnacaggggnncaanttnnnanncccttttnggggttcccaa

SEQ ID NO: 98 - DNA, 300 bp, Homo sapiens
atctctcaggaaggctttgaacaaatgaaagcagcagccatttcagcaagcgggggccacacctaaggttactcgagagtgaagattatctcagaagtttagaatcatgacacttcggggaagataggatcagggatgaatgggagacgggggcttaagggagagcttagaagtttagaatctaagagagaaagggtttgtttttggggagagggattatgtatgatatttaatagcacctgcaaactttaagatagctggggggttctcagtaactaaggagggtcctgaccctaaaag

SEQ ID NO: 99 - DNA, 287 bp, Homo sapiens
  misc_feature (1)...(287): n = A,T,C or G
ctgcattgtccactggacgttttagtcatattcagacaccagttgtttcctccactcccagacttaccacatctgagagaaacctgacatgtgggcatacctcagtgatccttaatagaatggcccccgtgcttccaagtgtcctgaagctgccagttagatctctaacatactnnantgcaagataagncaagagantnaccgagattttgncnncganannntactnnnnttgantttgntgcnatntantaactnctggannnnnnantntcnatncatccccc

SEQ ID NO: 100 - DNA, 263 bp, Homo sapiens
  misc_feature (1)...(263): n = A,T,C or G
cttccttctctatacccttctctatgttttattgcataaataggaaacattgttgaaaagactttcctggtaaactgttctgaattttacgtttatcgaaatatctccaaagactcaatttagaactttattatgcccttatttattnaacatttnttnggaacnaacatgtatatngcccttangtnggcnnnngcnagnggtnanannngngagntctnaatgngngnnnaanngngcggnnggntcggtnggnngnatgt

SEQ ID NO: 101 - DNA, 300 bp, Homo sapiens
gtggccaagggtggggccaagactccacatagatccaggggctcattccatgatgctctcatttcctagagtcctccaggtgtacagggaattgtttcactgacagacaggccaggatatctcataagcttcttgggcacaagttggagtggtatgggtggaattccagcacaattaggcatatcgtggttgggtgaacacaaccatacaagggggagaggtctctaccagtggcctgtgcagtcctgccatgttctttcctggtcaatgttttaaatgataacttggaatactactaaa

SEQ ID NO: 102 - DNA, 290 bp, Homo sapiens
  misc_feature (1)...(290): n = A,T,C or G
gtgcgtctagaggaaatgtactgttttgcagataataagtattgatcagacatgcatttttacctctgctgtgggattttagtctcattactttgttgatctactttgtagttaacctagagaagttaacacagccattgctacagagctttctgccacttgagttccagaattccagaatccagtttcctagggattgtggggagtaaaaagaggtatagggtatggtccctgtatgggagcaatacngnctttattgantagtgtctatattgtcttgtgactcaggt

SEQ ID NO: 103 - DNA, 293 bp, Homo sapiens
  misc_feature (1)...(293): n = A,T,C or G
attttttgacaggattttattttgtgtgcatgcattctgctccaagtgtcacaattctggttacaataattataatatttggagttactactaagactttcctgaaagaggtgtattgtaccaaattttgtaacatatnntnntactaantgatcntanagcttnctanattntgnatanggnatgtgntancancncnnnncnttnaacnggntttnnnngtcggntntgntttctnntngntggtgnccnatnnnnnntnntttntnngttcnttttngnnctnttgtttc

SEQ ID NO: 104 - DNA, 299 bp, Homo sapiens
  misc_feature (1)...(299): n = A,T,C or G
ggctgccccagcgttagcagcctgtaccaggtctatgacccgctctgcccacggctgtgtacgacatcagaccaggcactctcagggccgctctccagctcaccacagtgtctccacgtgccttaccccttctccttcaggccaagtttcgcggngtgctnaattaatacgagcacnagcaanaaattggacnggcangnaagnntntnnagacacctaagataaagtccggancccaaggctttancttaaccatgtatggtaccccattcattcatcnagaaaaccctcaacagctg

SEQ ID NO: 105 - DNA, 300 bp, Homo sapiens
cccgcctcggcctccaaaagtgctgggattacaggcgtgagccactgtgcccggccttcaattttatttaataattatgcatgtgtgggatgcaatgtgatattttgatacgtgtatacaatgtgtaatgatcaaattagggtacttagcatacctgtcacctcaagaatgtttttcataatattttatttgtaagataagcattcttcccatgtgcacaacattgctgggtattgttaagagatcatgaaaacacacaatccttattgagaaggtggccaggtgtggtggctcatgcct

SEQ ID NO: 106 - DNA, 300 bp, Homo sapiens
gactcttttttcctttgtattttctttctcagtctgatctgcttcctgacttcctggaaaccctccaaatttcttgatttctaatggcactctttctagatttctagccctgtacgataatattctttcatcatttcagtgggcttttggagggaggcggagatccaggtgatctgtctacactattcagtcagaaagctggatggtttttctcactgtttagctgtgactcatacttagaaagtggtttaaatgtgaatatcttagttctggttgtacaattgaggtaatcctcaattc

SEQ ID NO: 107 - DNA, 289 bp, Homo sapiens
  misc_feature (1)...(289): n = A,T,C or G
tagaggttggaaaggagtcatgaggggtgggaaactagcaggggcacatggaagctagggaaagaattttgcttgagatcgtcaaagtgaggggaagagggtagtaagcaaaggagaaatgttatatggggttcggaggttttagntctantntnnccctnttnatctgttctttntntngtnngctctntnttnctgcgnnagcntncttctctntnctnnatnnttatntnngtcctcgtntgtncntcncnncnttcnctntcttctttntctnnnctntccctat

SEQ ID NO: 108 - DNA, 295 bp, Homo sapiens
  misc_feature (1)...(295): n = A,T,C or G
ggtagaaggagcctcctcaaaggcagtgctgggcacccacgggtgtgctggatactggagtttgagaggagggaggtgctgtggccttggatactctaaaanagtngtaantntcactnntttgtgnctatannntnntngtacttctgctcaacnnnncttantttactgagnntattnnnncngnactttnatnntantnattntccntttatncctttactntnncacnttntgctnctttattgatanctggtctnatnactttctnccntcattgttnttcttacttttc

SEQ ID NO: 109 - DNA, 300 bp, Homo sapiens
gtcccaggaaattcctccccttattcttccttgaagtgcccgagcatgtagggcaagaaggaaggctgaagcgctgtccctaggaggaatttctccttcaggggagcctcagttttgcccatttatctaattgaatcagttttttacccaatcccccgattttgtaggataatctcccttatctaaagtcaactgattatggactttaatcacatctacaaaacacttccatggcgacagctagatgagtgtttgaataactgggactgtagcccgtccaagttgacacataaaactgac

SEQ ID NO: 110 - DNA, 286 bp, Homo sapiens
  misc_feature (1)...(286): n = A,T,C or G
tgtttttacctaaatgggcccacgtggcagcatgatttttgtcctttagcgccctgctttggggacctctctgtgctgtgccgtatagcttcaattcattcttccaacccggtgccttttggtctataatggagatggtgcagntnattncttngcacttgtcacaacgnnncncctaanncncnctgggaatnnnancccnctaatacctttanacatttaanaaatncatatttncgcatgncnaaacgancnnnanacncnatgnaaatctcgcaatatcata

SEQ ID NO: 111 - DNA, 269 bp, Homo sapiens
  misc_feature (1)...(269): n = A,T,C or G
gggcaaccctggctctatcattttccttttttgccaaaaggaccagtagcataggtgagccctgagcactaaaaggaggggtccctgaagctttcccactatagtgtggagttctgtccctgaggtgggtacagcagccttggtncctctgggggttgnnannannaaccatggnnncgtgannactnnntccagatggnttnnannnnnngncntcttcnttccnnatnctnntnntngnnttnagnctgtangntcttnctnnntcg

SEQ ID NO: 112 - DNA, 300 bp, Homo sapiens
cccaaacttaatgaagaactactcagcaagcaaaaacaacttgagaagattgaatctggagagatgggtttgaacaaagtctggataaacatcacagaaatgaataagcagatttctctgttgacttctgcagtgaaccacctcaaagccaatgttaagtcagctgcagacttgattagcctgcctaccactgtagagggacttcagaagagtgtagcttccattggcaatactttaaacagcgccatcttgctgtggaagcactacagaaaactgtggatgaacacaagaaaacgatgg

SEQ ID NO: 113 - DNA, 300 bp, Homo sapiens
gaactgtcccccgttatctctgtccatacagcaacagcccccaatggccctgaccacctccctccccagcagaacgccccttcgtgggtgtgaaaatactttctattctggtcagcaccaagaatgcctttttcccttctgcaggtcctccagtgattccccttaagaatgcccctttcaaagccacccccccatcgcagcggcacagctccctctagagttccttcacactcacatcctctcccgcctcaggtagaaatatccgcctgcttagctccaggctcccatgacatactcccg

SEQ ID NO: 114 - DNA, 300 bp, Homo sapiens
cctaggccccctggacctggtctttcagacacatttagccgtgtttccccatctgctgcccgtgatccctatgatcagtctccaatgactccaagatctcagtctgactcttttggaacaagtcaaactgcccatgatgttgctgatcagccaaggcctggatcagaggggagcttctgtgcatcttcaaactctccaatgcactcccaaggccagcagttctctggtgtctcccaacttcctggacctgtgccaacttcaggagtaactgatacacagaatactgtaaatatggcccaa

SEQ ID NO: 115 - DNA, 295 bp, Homo sapiens
  misc_feature (1)...(295): n = A,T,C or G
gctccagacagctcttctgtcatttcaccaggtccaaacaccagcaccaaggctcccatgaaatatcccctttattccatctcaaatccttacctatcaactccttgcccagagaacctggaataacatatttacttctagtccttttcaatgcattttccccttgggggaggtgtgggagggttgtgagtgagtacntgaaagannatcntacngatngaccatntttganggtnnctcanagggataaatanatatagntaaccgatgnnnnnncnncnggagaaaccatgat

SEQ ID NO: 116 - DNA, 269 bp, Homo sapiens
  misc_feature (1)...(269): n = A,T,C or G
ccccccgcgtctcccgggagcgtcgccgccacctgcacgcgtctggcacacaaacgtcggtctcaccccttagtttctggaagagaaaaaggaaaagccaccgagaggcctgaccctgaggggtcggtnggagatgcggncncgtattatagggaagcgattgatgagcgttgactgttcatcatntnaantgtatgntntnattttntttttttnttattatttctttttttatttttttnttttttntttatatnnnttttaattta

SEQ ID NO: 117 - DNA, 266 bp, Homo sapiens
  misc_feature (1)...(266): n = A,T,C or G
gtttacccttggtttattgtgattatcatggccattcccgaaagaagaatgtatttatgtatggttgcagcatcaaagagacagtgtggcataccaatgataatgcaacttcatgtgatgttgtggaggataccggatacaggacattgcctaagatactgagccatatcgccccaccattttgcatgagcagctgtagcttcgtantgnaaaaatctttgactcnncgntctgtnttnctcanntataggacccacttgaacaaa

SEQ ID NO: 118 - DNA, 300 bp, Homo sapiens
accatcttcactctctgggaagaaataaggtgggttaccatttacatcccagtgataagggccagtttgatcattccaaagatggttggttaggccccggccctatgccagctgtacacaaagcggcaaatggacactcaagaaccaagatgatatcaacctccatcaagacagctcggaaaagtaaaagggcatcagggctgaggataaatgattatgataaccagtgtgatgttgtttatatcagtcaaccagtattaaaggcctgcctgatatacaaccctcgaatgcaacacagtg

SEQ ID NO: 119 - DNA, 283 bp, Homo sapiens
  misc_feature (1)...(283): n = A,T,C or G
cctccatgaaggatatttttggagtcgtaggagttacatctgctaacatgcttattttcattcttccttcatctctttatttaaaaatcacagaccaggatggagataaaggaactcaaagaatttgggctgcccttttcttgggcctgggggtgttgtnntctngtnnntnantntnttggggnttnagnnctaannnagntcnnnggnctnttttnagagatangggnntctttgcttctngnngntcccnttttttnttgnncncnagnngtgttgtttt

SEQ ID NO: 120 - DNA, 300 bp, Homo sapiens
ttcagtaccaggggccggccgtggctcccatcctccggaatctgcaaaatggctacttcttcagaaataatggggagagggatggcaagaggccagagatcaaggccctcgagtattaacttgagcatttgggcacaaaatagacacttttggattttcccgtcttttccaacaccaaggatgagattatcaaaagatgtgttaaattaatttgtaccggccgggcgcggtggcttacgcctgtaatcccaacactttgggaggccgaggcgggccgaatcacaaggtcatgagttcgaa

SEQ ID NO: 121 - DNA, 300 bp, Homo sapiens
cacattattccttttccatcggaagtggcgctcgtgcattcaactcgttcccgctcatggaacccctctttaaaaagacgcagggcacctgtgagcgcaggagcgagcctaaggcctcccagcggcagcgcccgtgtcctgggcactcagcgtgctgggcagagcaggtgcgatggccccagtcctagcagccctcgcccatgtcctgtgcccttacatggctcccggactgtgcagggagccgatacgtttgctgatagcaatactggaaccaccgggtgcgatggcagtgaggagact

SEQ ID NO: 122 - DNA, 299 bp, Homo sapiens
  misc_feature (1)...(299): n = A,T,C or G
aataaacccaagggcaagcctttgaatgggtccacagcttggtacaagttcccatgctatgtgcagaacgaggtgccccatgcagaagcctggattaatgggaccaacctagctgggcagtcttttgtggctgagcagttgcagattgaatatagctatccttttacttttccacctgggttgtttgcacgctacagtgtccagatcaacagccatgtggtgcacaggtcggatggaaaatttcagatncttncctatanaggnaaagnngctgtggtntggnagnatanatgacctag

SEQ ID NO: 123 - DNA, 293 bp, Homo sapiens
ggccagccagctgctcacactggacaccacctctatccccctgcgcctctgccctgtcgcctcctgcccggacgcccgcctgctggccggctgcgagggcggctgctgctgctgggacgtgcggctggaccagccccaaaagaggagggtgtgtgaagtggaattcatcttctctgagggctccgaggcatctggacggagagtggatgggctggcatttgtgaatgaggacatcgtggcctccaaggggagcggcctggtcaccatctgcctgtggagctggaggcagacgt

SEQ ID NO: 124 - DNA, 208 bp, Homo sapiens
aggccagtgtgggacagggttgtgtaggtgtgcatttcaaacacatttattattcagaagtggtgcagataacgcttagattacaccgaagaatttagggagggtgggggatgaaggtctgttagtaaccagaaacacattagttgggcatcagtaaggggcaacataaaggaatggttcccctcaaaaacgaacaaaccaaatttta

SEQ ID NO: 125 - DNA, 300 bp, Homo sapiens
gtgaactctgcacagtccttgtatattcattggaaaacagcagtgctctggaatagttattttttgaaatgccctgagcagttaggaaagtgatgaagggtgaagtgcggagagggaagaggtggggcctgatgcagtttgctggggttgcaaccacacactccctgtaaggcctgaagcagccagttgcatgtttctagttggaaggcagatagagctgtggaggtggtggcatgattaggtctggctgggaataaggttgcttggcagtgtattatttattcgctaactttggtggcc

SEQ ID NO: 126 - DNA, 300 bp, Homo sapiens
gtttatgggtttacattgtcatgtctccacaggacaatgcacatggtatgtttgtcagaacccagttggagttttgtttcccagcatccaaaggaaatccctaactttcattttttcttcccgtaagcagccccgaacacttacttataagccatctctacctgaattagcaatcatggataagctcaataactgatcatttccttatcagtttaaaccatatatattttaacactgtctctttttcacacacactagttagctaagaatgagctggggggctgggcgtggtagttcacg

SEQ ID NO: 127 - DNA, 300 bp, Homo sapiens
gtaaggtagaaaaattcctcacatgggttaataaaccaatggatgaagaagcatcacaggaatcatcttctcatgacaatgtgcacgacgcttccacaagtagcgattcagaggaacaagacatgtctgttaaaaaaggtgatgacctactggagactaataatccagaacctgaaaagtgtcagagcgtatcttcagctggtgaacttgaaacagaaaactatgaaagagacagcttgctagcaactgttccagatgagcaggattgtgttactcaagaagtgccagactcccgccagg

SEQ ID NO: 128 - DNA, 300 bp, Homo sapiens
gtgtggagtgtcccaagcacagcaggcagtcagggtggccaatacaaggtgctggcagtgaagtgggggcagactgagcctgtgtagtgaagtgtcttgaggaacgtcagctgtatcttttaggaaaccaaaactgcatagacattgaacccaggcagaaggtcatgaagtcagagctaagaaatgctagtggggatagggggtgagatagagttgggaaatgtttcagagctacaggtgacagttgttggtgtccagttggatatgtaccatgaagggaagaagcagtcagagtgggca

SEQ ID NO: 129 - DNA, 300 bp, Homo sapiens
atccctctttgcagaaaaggttatagaatgctgttctttataaccaaagaacttacataagacaacatttttgctgtccactcttttgtgtgaacatgtatgtttgactgcaagtttggtgccataattcccttggctaccaagccacgtgctgccattctctgtcctttgtttcataagcacactgagaaatctcacagctatattctttggtcttccacctgcccctccacctgctgacttgacattgtattataactgttgacaatgactggggtcctgactccacagttgcctgga

SEQ ID NO: 130 - DNA, 300 bp, Homo sapiens
ttcgtcacgggtaattatgtgctggatcgagatgacctggtggaggcccaaacacctgagtatgatgtggtgctctgccccaaccctggtcgtcgtatggcaagagaaagactcttacagaaacgatctacaagaactactaccgaatccaattgaagccagagcagttcagttcctacctgacatccccagacgtgggcttctccagctatgagcttgtggccacaccccacaacacctctaaaggcttccagcgtcctgtgtacctgttccacaaggcccgatcccccagccactaag

SEQ ID NO: 131 - DNA, 300 bp, Homo sapiens
ggtggagggaggcagccggcatggcatggtgaggaagggccatggaagaggacagaacctgtccacggagtcaatgctgaggaaggaagacggaggatgaggccagtcaggtttttcgtggtggcagtgccttatgtttttatcgaagtgtatattcacacagaaaagcacatctcccaggatcctgagagagcttgaaccagaccactgtggacacggtggccacccgtcaccactacccttcccaaggggagacgaggagcaagtaggcttgagggaaaagctgcacaggactcgtgt

SEQ ID NO: 132 - DNA, 300 bp, Homo sapiens
atttgaggatctcgaccttgtccttccagcaggtgctcccaagccacctctgggcctgagaataggcatcacatgactctgtttaatcctccgacacagcaaggatgccgggaagcagggcaaagtggttcaagttatccggcagcgaaactgggtggtcgtgggagggctgaacacacattaccgctacattggcaagaccatggattaccggggaaccatgatccctagtgaagcccccttgctccaccgccaggtcaaacttgtggatcctatggacaggaaacccactgagatcga

SEQ ID NO: 133 - DNA, 300 bp, Homo sapiens
cccgctgagtggcagtggcaggaagtcggtggaagcagatccctgtgcagaagttgaattaccagggcggccacacacgggctgcacaacctttgcagtcgtgcacggcaagtgggatgtggcctccgcccatgattgggcacctggtcaggctgggagatccaaatagcacccagtgggcagctgtccgacccctggaggggcaagccaggaaagaaacttagggcccgctgtgaccagatgtcccttccagttgggaagactaaactggtttggccaatatctcccaggattcccctg

SEQ ID NO: 134 - DNA, 300 bp, Homo sapiens
ggtacctggtgcctctgactgcgcctctgcctttgccgcctggctcctggtggttcaagttccagaaaggtccgagggctgtaaggtccttagagaacctagaggctcctcctaggaacctttaaaaatgataccctgccctgcgttggagcctgtgaatttctttgcatgtgaggggccagctgtcaggtggtcggctgagccagggcagacccaggagcccagcacgccatcgcggaggcctttctgatggcacagtgctagccgttcctcctgcttctccgcccacttggccatgtc

SEQ ID NO: 135 - DNA, 282 bp, Homo sapiens
aaaaagcctgccttctgctccccagggttgcttttcccaggaggtgtgagcctacctggaggaggcttaggcacagggatacctgctggaggtctgagcgttggttgagcacctcctgtttgtaggatcctgtgccagagcctgtggggaggtggagagaggctaggagacatagcccccacccctgagggatgagacagctccctgcaggcaggctgtgcccagtcatctcaagcctacagctgggctgctggctgcatggtctggagggcggtggggagg

SEQ ID NO: 136 - DNA, 260 bp, Homo sapiens
  misc_feature (1)...(260): n = A,T,C or G
agatacattgaactcttcaggagcacagcagctgaagttcagcaggtgctgaatcgattctcctcggcccctctcattccacttccaacccctcccattattccaggtactacctcagcaatttggtggcccctacaaatggttaaaactggattacgcccttcaaggctttccttatgnagccccanttgaggacatcctggatttcctgggggagtnnncncagatattcgnctcatggggnnccctgnnnnnnnntc

SEQ ID NO: 137 - DNA, 300 bp, Homo sapiens
ctggtgtccatcagcacctccgtgatcctcatgcagcacctgctgcctgccagctactgtgacctgctgcacaaggccgccgcccatctgggctgttggcagaaggtggacccagcgctgtgctccaacgtgctgcagcacccgtggactgaagaatgcatgtggccgcagggcgtgctggtgaagcacagcaagaacgtctacaaagccgtaggccactacaacgtggctatcccctctgacgtctcccacttccgcttccatttctttttcagcaaacccctgcggatcctcaacatc

SEQ ID NO: 138 - DNA, 300 bp, Homo sapiens
gacggcagtggggaagttggcacaaccttacaaggccacactcgtgtcatcagcgacttggactgggcggtgtttgagcctgacctcctggttaccagctctgtggacacctacatctacattctgtgaagttctgggattaccgccagcctcggaaatacctcaatattcttccttgccaggtgcctgtctggaaggccagatacacacctttcagcaatggattggtgactgtgatggttccccagctgcggagggaaaacagccttctcctgtggaatgtctttgacttgaacaccc

SEQ ID NO: 139 - DNA, 300 bp, Homo sapiens
gatgcacgggcactttggaggaccgagcggccactctgagtaagatcatccaggtggcggtggaactgaaggattccatgggggacctctattccttctcagctctcatgaaagccctggaaatgccacagatcacaaggttagaaaagacgtggactgctctgcggcaccagtacacccaaactgccattctctatgagaaacagctgaagcccttcagcaaactcctgcatgaaggcagagagtccacatgtgttcccccaaacaatgtatcagtcccactgctgatgccgcttgtga

SEQ ID NO: 140 - DNA, 300 bp, Homo sapiens
tgtaggcacaagattttcttgctagcggaatgtgaaccaaaaagtgtagaggccaatcagtaaaaatattcaaagccagttttgttgttttcagcagttagtaactatcagtagatgaatatttactaggaaacattggtcttttaaccactttgggcatgcttcttatttagtatgttcatcatgatttagtatcatgacattcagcgaacatttattgagtgcctactgtgcactagggactagtaagcatgttaagtttgtaagctttgttgatttccaccacaaacccataggacc

SEQ ID NO: 141 - DNA, 234 bp, Homo sapiens
ccagatcctaaagctgtgtccttaatgacagcaaagttaagcacttcctttgtcctagagacatttattcattctaaagaaaagcccacgatgcttcagtggattgaactgttgacgaaacagtttaataatagtcaggcagcttgtgagtggtttttagatcgtatggctgatgacgactggtggccaatgcagatactaattaagtgccctaatcaaattgtgagacagatg

SEQ ID NO: 142 - DNA, 300 bp, Homo sapiens
ggaatatctaagcagacataaatagtaacatcagggcacttcagaatcttcatccgatttatatcttcataggtccatgtttctattttcaaatgtcctttatttcaaagcagcatgtcactaaaaaaaagaaatgggcaatcatcattcctcaaaagatacgtgcatttggttgggcaaaatcatccaggctaccagttggataataaaagtcgaaatgtactatttgattttttcctatgtttccaagcaagtatttctcaccagacactgcccccatcatatcccctttcctcttct

SEQ ID NO: 143 - DNA, 300 bp, Homo sapiens
aatacctttaaatccctgggcagcaccgcagggacagatattaccgtcaacagtgtgattctacttcctaaaaaccctgagcactttgtggtgtgcaacagatcaaacacggtggtcatcatgaacatgcaggggcagattgtcagaagcttcagttctggtaaaagagaaggtggggactttgtttgctgtgccctctctccccgtggtgaatggatctactgtgtaggggaggactttgtgctctactgtttcagtacagtcactggcaaactggagagaactttgacagtgcacgag

SEQ ID NO: 144 - DNA, 300 bp, Homo sapiens
ccaaaaggcataaagataagtgagggatggagttctggaagttgtgtattcacgtaagatttactttcaggtattggcaaaaatcacagctggagtgcagattaagcatggtaggagggtggtgattggagaaggaatggaggggaaaaaggaaaaactacaaatcatgttaaaactgtcctcattgagttttacaagtaatatactggtcttatataccctttcctcctaccgtgggaaaatatcactaacttgtaataggattaaatgaggcaatacgtaagctttttagacattttc

SEQ ID NO: 145 - DNA, 300 bp, Homo sapiens
gagaaaactgaaatcagatcatacagatgttctgtactataatataaaaagaagacaaggactgaaaagattgagtgtagaaattgacactctcagaaggagaccaaaaatcggttcttcatcccaaagacctattaaactcaaagaagcatcatattcaaatgataatcaaattattttgcagagtccttcttcaaatggaactaaaaaagacatacataaatgtgtagactttaaacctaaagatatcaaattgacaaatgctgggagcaagcttgaccatggaattaaaagccttag

SEQ ID NO: 146 - DNA, 299 bp, Homo sapiens
gcacgcccccttttctccgccacttcaccagtttctgaaatccaacctcccagacttcacaggaagatagatattcttgagataatgaaaagtgatatcttcgcataccataggagaaaaggctgaggtatatatgatttttaactgtattaggggtgtatgaaccagtttaaaaacgaggttttatttactgtagagatgaatgcaaatcagaaccaatgatcccttggcctacttagttaaaaccagttcatacatcccttagggtttttattattattattattattattacagtt

SEQ ID NO: 147 - DNA, 300 bp, Homo sapiens
gcacccagccggcttcatctcttcttgaaatcacttttataccattctatgtggttctcaccatgagcttgagtggtgggctaaagtgcctctccctgctttcagcttcctgctgggaactcactctctcaagttccttccagcaccaccccatagagttcccatcactccacactgtccagtgacaactcccaacatggaagatctgctagttctacagggtgctctctggctgccccagtaacatgtgtttttaaatttttcacatgcatgtttgaccccgactccccgaagtcaggt

SEQ ID NO: 148 - DNA, 300 bp, Homo sapiens
ccggctaattttttgtatttttagtagagatggggtttcaccatgttacccaggatggtctcaatatcctgagttcatgatccacccaccttggcctcccaaagtgctgggattacaggcgtgagccaccacacccagccagttttcctattttctgaattcagaattgacttctctgggaaaactggagatgagaatctgcccagtgctctgctgtccagtcaccgccttttgaattttagttttggcaccaggagtaccgttagctttccccttcttctggcccatttgcgtcatttc

SEQ ID NO: 149 - DNA, 296 bp, Homo sapiens
  misc_feature (1)...(296): n = A,T,C or G
ctcgcagctgtcagagttggtcctggctgtggcgtccaaacagcttgagggaaaaagattctggctaaccacctcatctactactcaagttctttctgaaggagggatttcttcagttaaccatggacagtgaggtttctcaccacagtaacttgagtccaggttgagggggagacagatctgtggtaaatctntgantngnncatcntantgantgnngaaccnctcaggactcnttatgnaangancttgtgtgtnaaagaaccnntggagcngatctggagacctatatgtgt

SEQ ID NO: 150 - DNA, 141 bp, Homo sapiens
ggaaggactacggatccgcaggaagaggcagttgggggccaggggcccagtagaggaggctgagctccttccaactcctcagaacctccactctatggatctggacctctggattcggctttctccctgggcactgccttc

SEQ ID NO: 151 - DNA, 300 bp, Homo sapiens
ccgagatggtgacactgcactccagcctggctgatagagcgagactccatctataaaaagtaaaaaagaaagtcttcagtgaaaggagattcgccctatcagctatgaaagcacagaggggaggaacatggagtaggggctgcctgcagtcagatcctgccctcacaaccttgccagggaaacaggctcgtgggtacaaaggttgtgtgcctcaacttcctcatggaagcacgtgagattattttataaccatagagtggagacagtcagtatgaccaccaaacccaggagccatatatt

SEQ ID NO: 152 - DNA, 300 bp, Homo sapiens
gtggttgtgccttttcccagctcgaacccctcaggcttctgcctggtgtgaagttcagattcctcaggctgagctgctcttgcctcagtttcccagcctgaccaaaggaagcaggtggggcctctgggataaagagcgtgtgctggcccttccctgtgtgccccgcagacacacactccaccccactccccatgccccagggcccaccaggctgacttctccgctgcttctgacgggctcccttgccctctgggttccagtcagccagcaggaggcaccagcaggaatcggagggtgaga

SEQ ID NO: 153 - DNA, 257 bp, Homo sapiens
cccctgtttacagcaataagcacgtcctcctcccccactcccacttccaggattgtggtttggattgaaaccaagtttacaagtagacacccctgggggggcgggcagtggacaaggatggcaaggggtgggcattggggtgccaggcaggcatgtacagactctatatctctatatataatgtacagacagacagagtcccttccctctttaaccccctgacctttcttgacttcccctttagctttagacccctt

SEQ ID NO: 154 - DNA, 300 bp, Homo sapiens
gttatcccggaagtctcaattcttcctgaagacctagaggagctctacgacttattcaagagagaacatatgatgagctgttactgggagcagcccaggcccatggcctcacgccacgaccccagccggccctatgctgagcagtaccgcatagacgcccggcagtttgcacacctgtttcagctagtctcgccctggacctgcggggcccacacggagatcctcgccgaaaggacgttcaggctcttggatgacaacatggaccagctcatcgagttcaaagcgtttgtgagctgcctc

SEQ ID NO: 155 - DNA, 300 bp, Homo sapiens
aaagaaagcagcagagaaaaaagggagtggtctcgtagcccaagaagacgcaaatccagatctccttcccctagaagacgatcttcccctgtcaggagagagagaaagcgcagtcattctcgatctccccgtcacagaaccaagagccggagtccttcccctgctccagaaaagaaggaaaaaaactccagagctcccagaaccttcagtgaaagtaaaagaaccttcagtacaagaggctacttctactagtgacattctgaaagttcccaaacctgaacctataccagagcctaaaga

SEQ ID NO: 156 - DNA, 274 bp, Homo sapiens
  misc_feature (1)...(274): n = A,T,C or G
catcacggttttacccagtggtgaaagaaggacggacactggatgccaagatgcctcgaaaaagaaagacaagacacagttcaaacccacccttggagagccatgtgggctgggtgatggattcccgtgagcacaggcccagtactgcttccatnatctcnannctnttatatggnatgcttactttnnnaannattnnntngttntntttngnatagctcttnggcttnnttntggnattgctntnntttnntnggttttgttntgttttttt

SEQ ID NO: 157 - DNA, 300 bp, Homo sapiens
gcagatttggttccatacctcttaaaattactcgaaggcattggccttgaaaacctggacagcccagcagccactaaggctcagattgttaaagctctcaaggcaatgactcgaagtttgcagtatggagaacaggtgaatgaaatcctgtgccgttcttcagtctggagtgccttcaaagatcagaaacatgatttgttcatttctgagtcacaaacagcaggatacctcacaggacctggagttgctggctaccttaccgcaggtacatctacatcagtcatgtctaacctgccacct

SEQ ID NO: 158 - DNA, 300 bp, Homo sapiens
  misc_feature (1)...(300): n = A,T,C or G
cctacccatgtgttcccgaaggctgggcactgagctcccacacccagcatacagctcattactcacacaccctctgccgtctacagagtaattagtagaggaacacgcccttttctctggagatttccgccccagtcgtaccaactctttaacaaggaacaaaagtcaacaacttcaagtttcctgtgaggatgaaatccagagtttctaatgactaatctccatcgtcaaaagaaaaggcaaacctcagccccttcagacagctaatgccaggagaagttcatgantattnnaagaaag

SEQ ID NO: 159 - DNA, 300 bp, Homo sapiens
  misc_feature (1)...(300): n = A,T,C or G
ccgactagtaacatatatcatagcttccaaagtatttgtttacagaataccacagtgactaattaccagaacttttcttattctctctgagcaaaggaacctcatgggagaaaaaaaatataggtcatttttaatgtaagggagttgctaggattggaggttaagacagctatttacacttcatgnanggantnnctgangacctcacaangngttntctaggnatagagaaaggtgcaaatcttcttatcagaaacgcattataaatagaaaagaaactcttaaaagagattcttcaaa

SEQ ID NO: 160 - DNA, 300 bp, Homo sapiens
ggcacagtcctctctgttcatagaaacacctgccagtgtcaaggattccagtcaggtgtctatcccaactggtcagggagagaagggcagacccattctcaaagaccaccatgtccaaggtctgacagctccccactggctgcccccacaggggctttaggctggtctgggtcatggggaagcgtccctcttatcgctggtctgtgttctcctgggatttggtatctatgttggtacgactcctggccttttatctaaaggactttggcttttgtaaatcacaagccaataatagacttt

SEQ ID NO: 161 - DNA, 288 bp, Homo sapiens
  misc_feature (1)...(288): n = A,T,C or G
gctggaggcattcgaaagggactcccgatgtggtgggcggggctgaaccctgtggcttctgaggtccctgccagccagagacttgtgtgagtctttgaatggcttcacatgaacaaaagagcatttctgtcacctttcctctagttttttncatcncaccnatctnngagctgaggcnnngttntttctcnnattntatttctntnntntttttnctctttttttnctnatatttttntntgttacannttnnnnaatttcnttnttttttttnnntcttctatcttt

SEQ ID NO: 162 - DNA, 293 bp, Homo sapiens
  misc_feature (1)...(293): n = A,T,C or G
ctcaaaagtcagcacaacaagtggaaactggccaaccagtatgagaaattccacagtccaagggaaagagaagagtatagtgactgaggtgggtctctctgtccaacatgcaggcagcactccctcatcctgctcagtgagagaattcagggggaatagaaaagctgctgagagttggtaaagaggatggtcgagtgagatggtgttgacctccctggatcttatgttactacatcctggacctcnagaggntcatccaanctttttgaaagctnatcttcttgnctggttaa

SEQ ID NO: 163 - DNA, 300 bp, Homo sapiens
gtggcgcagtctgagttcactacagcctccacctcccaggttcaagagattctcctgcctcaacctcccgagtagctgggactacagttgaaaaagatcatctagcaaagcctttttcccagctacatataaggaatttgaaagtcacataaaatggttaagaaaatgtgccaagattacctcagtaattctggtctgtgttctcaggagaccctggaaataaacaatgtgtcttctgtggcttcagcgtcacctagtgcaggctgccattcaacaaacgcattgtcaacagtcaaccaa

SEQ ID NO: 164 - DNA, 265 bp, Homo sapiens
  misc_feature (1)...(265): n = A,T,C or G
gccagattgaccaagcgccagagacaaaatgtggcacaacgagaaccccagccctgtccaggtggctccgcgcccagggcccaggcttagcagtgctccctgccctatcttttggaaattcttgcttttatggtnttnanctctttangccctnaatancnangtncttgntgngtgttncttntcnttgctgctnttnttttannntcnnnatntnnntttnngctagagctntngctantnatatnnttnnntttnntgtttt

SEQ ID NO: 165 - DNA, 265 bp, Homo sapiens
  misc_feature (1)...(265): n = A,T,C or G
atcaggactgtgtatgtctgagcacatgtggctctgtttgggattacgtgtttgtctgtgaatgtgtgtgtgtgttggagggttgtctattgtgtgtggctgtatagggtgtctgtagatcaagatgtgtatacagctgcttctgctattgctggtttgggggaggtgnctganaanctgnnactgnntatcntgannnaagangggngnanggcncacccctgntnctgntcatnnttaaccntgntcnnnatntngnnctctg

SEQ ID NO: 166 - DNA, 300 bp, Homo sapiens
gggttgagaaccaagggagtcagatcaaccagtcagatcaaccatgtggctgcaagacagggcagagaggggacgtcagccccaggcccctccacacctcatgtgcagttctacagcacgggcacaggcactgcctacacagagccaacctctgagcccagacccctccactgtaaaatgagaataagcactcaggatggttgtgaggattcactaacagactgagaagaaatggtgacctaggctggcacatgggacactccccaagatgctcctttttcatttccctcaagcccagag

SEQ ID NO: 167 - DNA, 300 bp, Homo sapiens
accaactgatgacccaccagcctaatctggcccacaaccatgttctgttcggtccatgttctatttaaaagtatcttgaattggttgccatcatttaaactcaatcagactttgaaggcatggtccagccacacagggcctacattcccacatggcaactatgaaagggctccagcccagcaggggctgtcccggtccctgccacccccacttcctgtgcctcagatctggcccctgctacgtaagataaggacagctacaggtccctctgagcctaaacccacctaaccggactaacat

SEQ ID NO: 168 - DNA, 246 bp, Homo sapiens
  misc_feature (1)...(246): n = A,T,C or G
cctgatcctgccaacagcagttcaggccagccccacatggagcaagtacctgaggcccagccccttggggacttgcccatcctggaagtggaggagatggagcccccgccggttatggagtccttccagcccgcccaggctaccgccccgcttgactctgggtgnganangnantttttgtttttatcttangaattgggncnttttgtgnnnnaattgnnttnanntttttntntnnnnnnttnt

SEQ ID NO: 169 - DNA, 300 bp, Homo sapiens
gcgaagcaggcttttgctcatgtatccaagttgctgtcacagtgtaaatttgatctgttggaagaacttgtggccaaagaggtgctacatgcattgaaagaaaaggttacttcactacctgacaaccataaaaatgcccttgctgctaacatagatgaaattgtatttacatcaacaggagacatctccatttactatgatgagaaaggaaggaagtttgttaacatcctgatgtgcttttggtatctaaccagtgccaacatccccagtgaaactttaagaggagccagtgtattccag

SEQ ID NO: 170 - DNA, 274 bp, Homo sapiens
  misc_feature (1)...(274): n = A,T,C or G
aagagacgagcggcccagacaggcctgggaaggcccctctgccccgtcaggggtgaaaagcaaagctggaaggattcggagagggttggggccgtcttcctcatccttccttttctcggggctcccgtgggtaggtgcacttggagcaaccgggcctgcggggtgtgcgggggtggaggttgnggaggnnatcgnncnnggcncncccnggtacnctcncnncnnncnccntnncnncncttctcnntntcnccncnnntccnncnnctccctc

SEQ ID NO: 171 - DNA, 300 bp, Homo sapiens
agaagactcttcccctgccaagaaaactcgtagatgccagagacaggagtcgaaaaagatgcctgtggctggaggaaaagctaataaggacaggacagaagacaagcaagatgaatctgtgaaggccttgctgttaaagggcaaagctcctgtggacccagagtgtacagccaaggtggggaaggctcatgtgtattgtgaaggaaatgatgtctatgatgtcatgctaaatcagaccaatctccagttcaacaacaacaagtactatctgattcagctattagaagatgatgcccagag

SEQ ID NO: 172 - DNA, 293 bp, Homo sapiens
  misc_feature (1)...(293): n = A,T,C or G
gatggccaaaaatatagaaaaggataccttgcatgtcctgtgaaatgcaaaggaattctaaagtgtcattatgagttacctcatggaagaaagcaaaaggtgaatctatctagagtttgtggttctgactcacaagagactgatgttcatgctgaaggacgagtgtgacaggtggaaggatagagcaccgagaccacactctaaagggtaggaatctatgggaactattcagggagatgaaagcatggaatgaactgaagcttgcagactcgttgagtannaagcgcgtttta

SEQ ID NO: 173 - DNA, 271 bp, Homo sapiens
aataccctcttcccttgcaatggcatagggacatctagaatatagagaagacagagacaatggaggaagagtaaagaaactgactatatgccttcttcatttcactgcaaggaaggccaagcagatttttgaatgaggtgtgagattgctgttaaattggactggcctggacattttaatcccttaaatagaggtgcaatgattaaagtgagatttgtcactaaaatttatggtatctgcccaagattcaggagtgatgttgggaggagat

SEQ ID NO: 174 - DNA, 300 bp, Homo sapiens
cctaagcaggcatctgcagcatcctatttccagaaaagaaattctcaaactaataaaactgaggaagtgaaagaagaaaatcttaaaaatgtattatctgaaaccccagctatatgtcctcctcaaaacactgaaaaccaaaggccaaagaccgggttccagatgtggttagaagaaaatagaagtaatattttgtctgacaatcctgacttttcagatgaagcagacataataaaagaaggaatgattcgatttagagtattgtcaactgaagaaagaaaggtgtgggctaacaaagcc

SEQ ID NO: 175 - DNA, 300 bp, Homo sapiens
aagagacagcctctctcttctgtctcagaagctctgtgtttgggaaactttgagcccagtgagtagcagggtctgcagtgtgagtaccaggtttccctggcaatccaggtctcctctgaggaagcattctgacttcccactgaccacggaaggcatgtcagcttcatgcctcgggctagagttctgataatcggggctgaggggtgaaaaagaaaatccagtcaggacagacagtggggagacaggtccctgccctttatttgcgggatcaatcagggactcccagaaaggaaggagaat

SEQ ID NO: 176 - DNA, 300 bp, Homo sapiens
atctgttcagttctggcttgaaaatgtgtgtgccatactgtgacccacgggcagcccctcctcctctactgtgtcaggtggaccagggtcacctctgttctgcgcagctttgagattctaggattctacggccggcacgaatggcatgggagggttctctgcacgggacggcataacggcatgccatccttcaggctggcaggagcctgcgcaggtgtggcaaaatcttgaaacagcctgtgtcctgcctggcttttcactttcctatttaatataagaaagcacttttttttctgcttt

SEQ ID NO: 177 - DNA, 268 bp, Homo sapiens
  misc_feature (1)...(268): n = A,T,C or G
caaagtgtgactttgctagcagtttactcaacaatgggcatgtcatctagagttcccaagatttttaccatcctgcaacagcagtcataggagaatatgcctcaatcaaaatcaggctaaaaatttgtttcaattctgcgtgtgagctgggaccttangnctttctgntctctatttntnttttcttntnnnntctnttncattncgtnantnncnnnnnnnnantnntcnnnccnntnttctnnaatntttctnntnatnttaatta

SEQ ID NO: 178 - DNA, 300 bp, Homo sapiens
agcaaatggtgctggagtgcggtggctcttaagagtctccacagtttgctagtttgaatcagggactggatttgttgtaatatttttgagtatttatggttgtgactcaatatatccttccttattggatacattgaagtctaactgagaatcgatatttgttccttggacttgagtgtgaaggaaagagaagctttaattactactacaacatgacctcaaagtttttcaagtactcaatgttgtgttttctttttaatggggctgtttgtgaagatgaggcattaggatgttgtgatt

SEQ ID NO: 179 - DNA, 270 bp, Homo sapiens
  misc_feature (1)...(270): n = A,T,C or G
caacaaaagtcgtgagtgatcagtgaaagctctgctgtgaaggtgacatttgataactggggaagactgttcaggtaatgggggcacatgtgtgtgcagaggcctgaagaaggtgctggtgtggcaagaatagccaagagactcatcactggacccgatggggagaggagtaaaagaaaaggtccaagaattggaagagatggcgggcaggtcatgtagggccttacaaanaatttgactttggctgagagggnagccgttaaaagggtg

SEQ ID NO: 180 - DNA, 300 bp, Homo sapiens
atcagatggggttgtttttattggtatccagttatgtttgcttgtctttccagatgggcccagttattagccatacatagtacattgatacacctccaccagcgggtgaggaaatgatggaaaaaggagtaagaagtggccattcgttttaatcattcctcctggatttgtcctcagtccccaactgccaagtaggatgtgtccatgtataaatgtgtggggcatgactaaagtaccacgtagctgttctttatatttatttacctagaaagatctggcaaagaactcaaagaaaattgt

SEQ ID NO: 181 - DNA, 260 bp, Homo sapiens
  misc_feature (1)...(260): n = A,T,C or G
gttggcttccccgggagaggagtatgaggattaaaaatattcagaaacaaacaaaagaacacaaaaatgcaaacacatggtagggaattactactgcttattctcaacagtaccacagaaccagtgtttgagtgctggcaccatatgcaacatggggcatccgggctggagtgatccagctttttagattcattgtatgantcatgntaaggnnnaggagtcttnnnntanncnannangnnnncnnttnttnnnttacc

SEQ ID NO: 182 - DNA, 300 bp, Homo sapiens
ccttggtgcatgggcctggagccctggggggaactgtgggaactctgagccgtctggccctgagggctcagcctcagcctccacatctgcctgttgcggtcctggctgtggggtctcaggataaggacatagccccctggaagctgggaaggccccacatcaggccttgcagtttctaacccaggaggtggccgacagcagtgcgttggggctgcctgtccctgcacacgaggccctggggggtgaatggaggctctccctgtttttgttagcattggaggcctgagcagggctaacgcc

SEQ ID NO: 183 - DNA, 300 bp, Homo sapiens
agaaggacttcctaatccatgaaaaccatgtaaagtttgatcatatcattagctattggtcagacctattttgttgtttgagaaaaacagacacatggggaaaatggtgaggtgaggtagtgtgttgaggagctggaagtgagcagctcttaattttttcctcctgagactgagttcggaagaagagtagaccatggcatggaggtgggagagacaaggacagagttggggaggtcactgcctcacacttctgctcacaccgctgggtctggtggaaactcaaagtttgtatctaaaaat

SEQ ID NO: 184 - DNA, 265 bp, Homo sapiens
  misc_feature (1)...(265): n = A,T,C or G
gtcctccctcgtgggcctcccaaagtgctgggattacaggcgtgggctcccgtgaccagcctggaacgtgctgatgagcctctttttctcctgaaaccccggtgggaacagatggtggatgctttcaaaacgcattgaanntgnacttnaagacntgcggantgntntnngangantttttgagattttttttaanatanntntttttanntttnannnnccnttggaancagatngngtttntntnaaantnnattnaatctgt

SEQ ID NO: 185 - DNA, 300 bp, Homo sapiens
aaagaatgaaatgtccaaacccttactgacaaattatacctgacagcagaatacacccacatctactaagaggcttccatggtttttactgctatcactttgattactccaataatgaaactattgaatctgtttcttagaagccaaggtaagaaagcagagaatagtctgccattgaactgatagcatctgttttataattatctggtgacttttctagagaagatgtataaaggctgtgttgtttcatgtacaccacacttgaatgattgcttcttgagttggattgtactccagtta

SEQ ID NO: 186 - DNA, 300 bp, Homo sapiens
cttttgtaagattttgttccctcagcttgaggaacaacttcatcttcaactttttatttctccctgatgttacagtttggtagatttcaaactggaatagctagcatgtgcttgctaaataattttatgccagccttatcctgtatcctagctgttcttaacagcaggtacaaaaatgcctgtttttcagcaaggttgaaattgggaatgtccttttgaatcagaagaagataggccatagactcatctcccagcacaaaggggcattctatgaaatggtactggccctaggaggatttc

SEQ ID NO: 187 - DNA, 300 bp, Homo sapiens
gcagactccaggttaaaagcgcttaatgcaacattcagagtgaaaaacccagacaagagatttactgaccttaagcactatagtgatgaactgcagtctgtcatctcacatcttcttcgagtcagagctagagtagcagatcgactctatggtgtatataaagtacatgggaattatggtcgagttttcagtgaatggagtgccatagaaaaagaaatgggtgatggactgcagagtgctggtcatcatatggatgtgtatgcatcttctattgatgatattttggaagatgaagaacat

SEQ ID NO: 188 - DNA, 300 bp, Homo sapiens
gtcctccaagacctgattcagcctttcacacggtggtgccactggtcccagggtgcgccggccccatctcctcagggcagtgggtggggaagactcaccactacccctaaaatgggaagagaccagggttccaaagtgacccccagtgggggcttcacacgccagggagtacatgagatgatttctgtggtccctgatacacagctttcattttgagagacacaattatttgagtatctagtaattcaagcctgggattcaaagatatcatttaagatgaaactgaatatttctcttctg

SEQ ID NO: 189 - DNA, 300 bp, Homo sapiens
cctgaactcattaccttcaagtatggaaatagcagtgcttcaggaatagaaatcttggcaatcgaaaggtatttgattccaaatgcaggggatgcaactaaagccataaaacagcagatcatgaaagttttggatgctttggaaagttaatataaaagaaaattatataaaaagaaattaagacaaccaagagaaacatggacatatacctcctgactgaatactaactggagacctttcatttgctcatggggctgcttaaatagcaggtctaagaaagtgtaaattattataatcaat

SEQ ID NO: 190 - DNA, 300 bp, Homo sapiens
gtggagatgacccctgagaagttcagtgtcttaatggagaagctctgtaaaaaggggctggcagccaccacctccatggcctatgccaagctcatgctgacagtgatgaccaagtatcaggctaacatcactgagacccagaggctgggcctggctatggccctagaacctaacaccaccttcctgaggaagtccctgaaggccgccttgaaacatttgggcccctgaccatccaccaagggaccaccctcttggtgctccatcaccagcttcctgaagggcatttctttcttcaccacc

SEQ ID NO: 191 - DNA, 266 bp, Homo sapiens
  misc_feature (1)...(266): n = A,T,C or G
gacaagcgctggagccgcagccctcagactggcacgggaacgccagcgttgggtgttcagattccacgcgtatgtctgggctcactcacagcatggccgagtgtctgcagtgctggtcctgacccttccagagcagcagtggacagatgagataagactgtttcagaaacnaanatggncacagccttcctaacangcaggtcatctggccatgtctgtatngtnacttgttaaaangcttcngtnatattgattgatnanatatt

SEQ ID NO: 192 - DNA, 300 bp, Homo sapiens
tcctggatcagtttctttgtcatgtagccaagactggagaaacaatgattcagtggtcccaatttaaaggctattttattttcaaactggagaaagtgatggatgatttcagaacttcagctcctgagccaagaggtcctcccaaccctaatgtcgaatatattccctttgatgaaatgaaggaaagaatactgaaaattgtcactggatttaatggtatcccttttactattcagcgactatgtgaattgttaacagatccaaggagaaactatacaggaacagacaaatttctcagag

SEQ ID NO: 193 - DNA, 281 bp, Homo sapiens
  misc_feature (1)...(281): n = A,T,C or G
cacactataaatggaagaaaaaaattaatagcttctgtttaatctgatgaatgtggcttcttttgccttcactatattgccctgtgaagctgctctttggtggnntatttatngnactgnctgntnttattttgcttattgcctttnttnnnnttgnctttatcncattttntngttnttttnttcnnttgnttacnntttnnnannnttcntnngtttnatttnnnngnntcttntnttaanncngnggantnnttttttctnnngnngannntttcttt

SEQ ID NO: 194 - DNA, 300 bp, Homo sapiens
tgattgatgagggctgtcggccaggaactgatcgaggcttgttaattgcatttgtcaaatgcagggaaattgggaattagtgaaatcggagaagggggtttggaaaacaaatgactcgtgcctaaggaaattttttgcaggaaagtatctcaggagcccctgcagtcagggagctgctggtgtggactcagactacatggttgaaataggcaggagctgggcggggcacagtggctcaggcttgtaatcccagcaccagcactttgggagacggaggcaggcagatcacttgatgccagg

SEQ ID NO: 195 - DNA, 278 bp, Homo sapiens
  misc_feature (1)...(278): n = A,T,C or G
gttaacagtgatgatgacagcgtgctgctggtacactgtatctcaggctgggatcggacccccctcttcatctccctcctgcgcctttccttgtgggctgatgggctcattcncacgtncctganncccantgagatcctntacctcnctgtggnctatgacgggttcctcttctgcacntgnnggttnttctnatcnttattttnntnnttagtnntttnctantttntgnntattnntnntatntnntataatcnntnnntnnnttcctattattt

SEQ ID NO: 196 - DNA, 300 bp, Homo sapiens
agagccctctgtttgcagctcatggaggaagcagcagggaaaacctggcgctgcaaaatgtgcaggctcgaatacggatggtcctcgcctatctgtttgctcagttgagcctctggtctcggggtgtccacggtgggctcctcgtgctgggatccgccaacgtggatgagagtctcctgggctacctgaccaagtacgactgctccagtgcggacatcaaccccataggcgggatcagcaagacggacctcagggccttcgtccagttctgcatccagcgcttccagcttcctgccctgc

SEQ ID NO: 197 - DNA, 300 bp, Homo sapiens
cttgggcaagctctttatcctaagattcctcagtgagccttatagagttgctgcgagaattacatttgttcatgatgtcaagtgtctggtatgtagctaatgcttattgaacacatagtaatttattgaataattgtcatgatcactggatgagatatagccactgtggaggtaggcacaccagggttttagaggcttgggatcttgcaacaggattttcctcttgcctctccaaactgccctttgcccagatggcttcagcatctttttgcatccctgtttccttgtttggtgaacacc

SEQ ID NO: 198 - DNA, 294 bp, Homo sapiens
  misc_feature (1)...(294): n = A,T,C or G
ccactaacagaactgaagaaaattctaaacgaaatggcaaaaagaaaattcattttttggctctctgctctgaagaacccttgttataacgtgtttatagcatctttggtagatggagagagatcttttatgacaaagagtgtgatacaatttttttaatgcatatagggcattgttcttcctagagcatatttacataaattatctcatttggaaaacacaacaaccttatacttgtgtctgcattcgcttgggcattttaaaggtcggaagaanttgaancttttcaagagt

SEQ ID NO: 199 - DNA, 263 bp, Homo sapiens
  misc_feature (1)...(263): n = A,T,C or G
agttccctcacttctctgcacacctattcccagattccatccagagcaaagctgatgtttatcgtctcattgtacttaggctttcgtactttaaaaaattatgactttttaaaaataagccttcagcagacagaagtgaagaaatttagcctgggttgcctcagcaacaaagtctgcggttcctaagagccacatgttggggaagcggggtgnntnnnanntgttgnnganggngnnnnnnnnnngnnnnnggnnnnnngnnt

SEQ ID NO: 200 - DNA, 276 bp, Homo sapiens
  misc_feature (1)...(276): n = A,T,C or G
cctctccttccatgtcacaaactaacccacatcaccattttgcaaacatgcatccttggtctcaagttggcctaacaaggaaattgaacagatccattgaaaagataattgaaagcacatatcctcttggatcagaaggacatttagcatggtacctctgcatcattcatgtgttcattcattcatttcacagatccttcaagaataccttctatggcctagacactgttgcatgtgaagnccacnganaaccactattncaancgggaccccttt

SEQ ID NO: 201 - DNA, 300 bp, Homo sapiens
ggggagtaacagaagcctggatacaattactctatcaggagatgaaagggactttgggagactgaatgtgaaattgttttataattcttcagtagaacagatctggatcacagttttacagtgcagagatttaagttggccctctagttatggagacactcctactgtttctataaaaggaatacttacattgcccaaaccagtgcatttcaaatcttcagccaaggaaggttccaacgctattgaatttatggaaacgtttgtatttgctattaaacttcaaaatctacaaactgtaag

SEQ ID NO: 202 - DNA, 300 bp, Homo sapiens
atgtgcctgtaatcccagctactcgggaggctgaggcaggagaatcgcttgaacctgggaggcagaggttgcagtgagctgagaccatgccactgtactccagcctgggcaatagagcgagattctgtctcccaaaaaaacaaaaaacaacaacaaaacttgctaccacccagggattttctgctatttaaaaggtgaatttcttttctggtactaaactgtagctgcttaacttagtaaaggctgtgtttggccaggcctgtgccagaggctcacctggagtgctccacccactggcag

SEQ ID NO: 203 - DNA, 300 bp, Homo sapiens
aagaactccatgttccacttagaggcttcagagtgcagtgccaggggtgccttcccaaaagtcctccctgcctgggtggagcgtagacagctcagcaccccacggggggcgttggagccagccttggttttgttgggtaaggatgttagaagaggggcgaagacccatagccactggtgtgaagggtctgctcttgaccgaaggctgcctccctctgggtgcagaccaggcaggtggtcccagtcacggtgccctggggccactgggtctgtctgccctcaggctccactagacacacct

SEQ ID NO: 204 - DNA, 300 bp, Homo sapiens
ttttgcacaagacaggttgctgaggggtcggcaagcatctgacttgcccaatcccctggatatggtgagccccgccatgcttttattctgtatcgcttttgtctttattgctgctttcaacatttacgtttggttacagttaactattttcggagtgtggtgattgaagacaatttcatcatcccactgtactttttttttgagagggagtttcactcttgttgcccaggctggagtgcaatggcacgatcttggctcactgcaacctctgcctcctgggttcaagcaattctcctgcct

SEQ ID NO: 205 - DNA, 300 bp, Homo sapiens
gccatttcttctggcctttacaaaaaggcattttgttatactacagtgtaaacctcatttttttcactccaaaaggtagcagcccctcttcttcccaccctggacctgcctttcactccctgggcacagagcgcatggtaccattgatgtttggtttattccaggatccaaggagctggttctgctggttggaccaaacctcgtgagccagccacccctgacccaaatgaggagagctctgattctcccatccgggagcagtgatgtcaaacttctgctgctggggaaatctcatcagca

SEQ ID NO: 206 - DNA, 300 bp, Homo sapiens
ctgacttcaactgcaatggtcctgtcaacacacagggattctacaggggctcccctgggtgcgtcatggatgctgttctgcgccacggctgtgaggcagccttcgtgagcctgctggtagaatttggagccaacctgaatctagtgaagtgggaatcgctgggcccagagtcgagaggaagaagaaaagtggaccctgaggccttgcaggtctttaaagaggccagaagtgttcccagaaccttgctgtgtctgtgccgtgtggctgtgagaagagctcttggcaaacaccggcttcatc

SEQ ID NO: 207 - DNA, 300 bp, Homo sapiens
ctcaaagaaatccaagacagacaactcttctcttagttcaccactaaatcctaagttatggtgtcacgtacacttgaagaagtcattgagtggctcgccactcaaagtgaagaactcaaagaattccaaatctcctgaagaacatctagaagaaatgatgaagatgatgtcgcccaataagctgcacactaactttcacattcctaaaaaaggcccacctgccaagaaaccagggaagcacagtgacaagcctttgaaggcaaagggcagaagcaaaggcatcctgaatggacagaaatc

SEQ ID NO: 208 - DNA, 300 bp, Homo sapiens
gtaaggcctgccttttacacaccagttgtgtgtttgttagtggctgctggatgccagtccacaccctcaaacacctcacagtcccaaacggggtgctcctacaggtcccagggtcctgttagtggaagaaaggcagttccaggaagtcttcctctagccttcatgacaggaagtagttaatcctctgggaaatagacttgcagccctgggaagaaaagagttgttcctccttggggacatacaccatcatctgggctatttcatccagtgtctcttctttatacaggagctcctggctca

SEQ ID NO: 209 - DNA, 265 bp, Homo sapiens
  misc_feature (1)...(265): n = A,T,C or G
agtggctgagtggaggcgcccagacctgggcaggcagcaggctcaggcccacaccttgtgatttttgaaaccaaagcccagaagatgatgtttacttctctctccctggctctgcccttcttactgcaaaccatgctgtgccttagggcccttctcatagctgttcctcatggccatgactggaacagggatgcaacctctttctacacaagcacagttagttgggtgaagtcttttttttgnttgnnttanacggagtnanact

SEQ ID NO: 210 - DNA, 300 bp, Homo sapiens
ccgggactgacaccactggccaggaagtggctgaagctcagctggatgaggatggggatttggacgtggtgagaagaccacgagccgcctctgattccaacccagcagggcctctgagagacaaggtacatcccatgattctagcacaggaagaagacgacgtcctgggagaggaagcacaaggcagcccgcacgatatcatcagaatagagcacaccatggccacgcccctggaggatgttggcaagcaggtgtggcggggcgccctgctcctggcagactacatcctgttccgacagg

SEQ ID NO: 211 - DNA, 294 bp, Homo sapiens
  misc_feature (1)...(294): n = A,T,C or G
ccaggatggaggtccgggcctgccccaagggtcccaccacagccagcgggctggcctcccaccccagcatccatacacgtaggcctgttgctgagggaaggccctctagggtcatctggtccaggggttctttgcttcagctgcacatcggctgcctctccaggaagcgtgttcaacacatggaatcagggctccacccagacctgccgaggccacactcctggagtatctgcatccaaagatctgcacgtttgtaaagctaaggggtgntnnttggantaagcttnaggtttg

SEQ ID NO: 212 - DNA, 299 bp, Homo sapiens
  misc_feature (1)...(299): n = A,T,C or G
gcaagaccagcatctggacagtgggggctcttgagagtccccggcgccccccacaccaggttgtcctataaccctctcccctctgtggagacgttaatgccaaggggtgtgtgnnnaggnaagtcctnntntgcanccaagattgacagatanttctagtnacttccngggnntccattcttattttattccaatatnaananaatncaggttntgtcanattattaaggtgtgcttatctatattttaaanaatctnttacanngttttcttgcatctngtnccattcatgtcttaca

SEQ ID NO: 213 - DNA, 255 bp, Homo sapiens
  misc_feature (1)...(255): n = A,T,C or G
aatatccccaaataacatgtcttacatgtttggtaagacttactgtaccctgtcctagaagatagaagatgccctgcccttagaagacaaagagactgtagagctatgccttctaaatcttaagccactcttcagataatggatcccttcatggtcagcccaaacatctcaagaacttttaatttgtaccgtttgtctttttttccatctatttaataccncantnttnactttattattatgaanccnatatct

SEQ ID NO: 214 - DNA, 138 bp, Homo sapiens
tgcctgcgagggctgccctctgcagagcgctctctgtgtgccagagagccagagacccaagacagggcccgggctctggacctgggtgcccccctgccaggcgaggctgactccgcgtgagatggttggttaaggcgg

SEQ ID NO: 215 - DNA, 300 bp, Homo sapiens
agccgagctgggccgtcctggggatcggtacagctccctggggtggtgacaggccctttgtgaaagttgtgtgcttggtcttccaccccagccccagacactgcttcaaatagcaccaaccagatgggagtccacatctgtggtggcaaaatgctgacattttcccaagaggtacacaaggtgggagaggcctgctgtagcagaggtgtgtgttagagaaagcaggggcctgatttagtagcagagaactgggtgagaaaaatggccagagaaagtgacctgccagctaccagtgtttcc

SEQ ID NO: 216 - DNA, 300 bp, Homo sapiens
agctcattaacttaccagaggttttaaaatctgagaagcactcattcaaatgctttggttttttgccatttgtatttcaggagatgcaagcagcattgtatctgcaatttgctacacagtccctaagtcagctatgggaagtagcctctatgctctagaatcaggctctgattttaaatctagagggatgtctgccgcgagtcgtgtgatattcgggcctggtgtgaccatgtccacctgtgatgtcatgcttattgatgacagcgagtatgaagaggaagaagagtttgagattgcctt

SEQ ID NO: 217 - DNA, 300 bp, Homo sapiens
agtagaatagtcttttatgaaataatatacttatggaaaatatatgactggtatatgattcctttagaggaagaaaatttcaattttcagattcaaaggaagcacccttcctagtctatatatatagtaagcggagaactagttttacagtgctcatttcaggtcttcagtaagtgtgtatgatgatgtcagaagtattcattggctcactttcaaatcactgaaaattcagccatgctaaggttggctattacgtgtattagcgtttccaagcgagtggtcttggctggggtgagattg

SEQ ID NO: 218 - DNA, 300 bp, Homo sapiens
ggtagacagcttcaagtggtactcggtgggatacatgaaacatttggaccgtgacccggaaaagttgacgcaccatatgcctttgttttactgtctctatgagaatcgggaagaagaatttgtgaagacgattgtggatgctctcatggaggttacagtttaccttcaatcagacaaggatatgatggtctcattatactgtctggattactgctgtcacctgaggacacttaagttgagtgttcagcgcatctttcaaaacaaagagccacttataaggccaactgctaggttgtccta

SEQ ID NO: 219 - DNA, 296 bp, Homo sapiens
  misc_feature (1)...(296): n = A,T,C or G
ctgcaaagaaaggaagatttttctttttacaactagatattagttttagaggaaggaaatagctgaaaaactaaatttgctttggtgaaatgtcctgtncngancagtnccttggcatacnacanctncaatnggggagntnttatacatnctctgacgctntantnntanggngactctnnatttnctgnncntnttanggttnnccnntngtctgttntcttnagtanaattangcntccttnnanngttggtgtctnntnntgcatatcnntttangcttttnttnatattta

SEQ ID NO: 220 - DNA, 300 bp, Homo sapiens
  misc_feature (1)...(300): n = A,T,C or G
atttccctttgccctgccactttcaccatagggccttcttacctggcagaggagtgccttagataccagaagattggcagggaagaagggcagccacttcctggttaccatggagaagcttgtcatgctccaagcctgtgcttacttgtccagtagcaacaatgggaaactgtattatttggggtaggggtagaaccctgagggcataaagctcagaattccangctgcatctggtanaatcggcttggcnggggttcanctgctccctgggaggccttggcatactnaggctgctccag

SEQ ID NO: 221 - DNA, 300 bp, Homo sapiens
gtacattgtcctgacactggaaaagacatttggaatttactttttgacctggtctgccatgaattctgccagtctgatgatccacccatcattcttcaagaacagaaaacagtgctagcctctgttttttcagtgttgtctgccatctatgcctcacagactgagcaagagtatctaaagatagaaaaagtagatcttcctctaattgacagcctcattcgggtcttacaaaatatggaacagtgtcagaaaaaaccagagaactcggcagagtctaacacagaggaaactaaaaggact

SEQ ID NO: 222 - DNA, 300 bp, Homo sapiens
ggagaagcaactgacgacagatgctgcccgcattgtgcagatgcagcccagaagcagatccagagcttgaataaaatgtgttcaaaccttctggagaaaatcagcaaagaggagcgagaatcagagagtggaggtctccggccgaacaagcagacctttaaccctacagacactaatgccttggtggcagctgttgcctttgggaaaggactatctaattggagaccttcaggcagcagtggtcctggccaggcaggccagccaggagctgggacgatccttgcaggaacctcaggatta

SEQ ID NO: 223 - DNA, 300 bp, Homo sapiens
ctcaatctcttgacctcatgatccacccgccttggcctcccaaagtgctgggattacaggcatgagccactgtgcccagcccctcccttccttgtttttgtaaaataaagtcagagaaacttttccagctatagtcaactaatacacattgatttgaaggagtagaaactgaggagtttacataaaataacttctctgtgaagtattagtgagatgatcaggcctggggtgggagcttgaagagaggagtggataaagcagtcaaggtcaaacaggagtgagacagtgagcaggactgaa

SEQ ID NO: 224 - DNA, 264 bp, Homo sapiens
  misc_feature (1)...(264): n = A,T,C or G
accacgtcatatacagcctacaaagagctcttgactgtgagctcgcagaggcccagttgcataccactgccattgacaaagagggtcgtcgggctgttaaagcgggagcttatgctgcttgccaggaagcaaaggaagatataaagagtcattcagaaaatgtctctcaacatccacttcatgtagaagtattacactcagagattatggctcattanaaatntgctttgngccttnnttnctgnatnaatnnntttattttnt

SEQ ID NO: 225 - DNA, 300 bp, Homo sapiens
gaaacatggggaaaagttcgtaaactcctggttgatgcaattcataatcaactaactgacatggaaaaatgtattttgaaatatatgaaaggaacatctattgtggtccctgaaccactgcactttttattaccagggaaaaaaaatcttgtaacaatttcatatccttcaggaataccagatggccagctgcaggcctataggaaggagttacatgatcttttcaatctgcctcacgacagaccctatttcaaaaggtctaatgcttatcactttccagatgagccatacaaagatggt

SEQ ID NO: 226 - DNA, 283 bp, Homo sapiens
  misc_feature (1)...(283): n = A,T,C or G
cagcatctttcaggtcatccggagctgcaatcgaagtctggagacagacgaggaggacagccccagtgaaggaaacagctccaggaaaagctccttgaaggataaaagccgatggcagtttataattggagatttgttggattcagacaatgacatctttgagcaatccaaagaatacgactctcatggttcagaggactcacagaaggccttcgaccatggnacggagctcatcccttggtcgtgctgtncatccaanccgatgtgcccanttcntgcttta

SEQ ID NO: 227 - DNA, 300 bp, Homo sapiens
gggaatatcctcaaccttaaatccttatctgccgttactcagggatatactaggattatgtcatcaattatcttcaataatagcatttttggtcaaattaaatgagtggtaagcttcttcacaatgtgaccattgaaattgaatggtttgttctgtacctttttgcttcagcaatcaattttctccattaagatgggacttgtactttaattcagatatggtacctcccgaatagaaaataaattatgttaatatagttgtaataataagtgtgtgttaagatttggttactataaacta

SEQ ID NO: 228 - DNA, 300 bp, Homo sapiens
gctgggtgcatgtgctaccacacccaattatgaatttcatcattagtttcttagtagagtccacatgtcctcagtagtaagttcatcagtgctaaatatttgaaggtatttctactgttttgtaaaagtaacttaagcctacctggtctgctatcttttgagtatttatactttctacgggcttgtaggtaaacataaaaagagaaaaaatatcccaataatacagtttttaaccttttatgataaagacatgcttagaatgctgttaagccttctgagatttaaccactgaaactaagt

SEQ ID NO: 229 - DNA, 300 bp, Homo sapiens
tgagctgggagaaggggagaaagtttgtgaagaggagatcggtgacctgggctccttatgtgcctgaaagagtttgagtttcctgttaactccaaatcaacagtattttcaacaagaaatgtgcaattgaaatcaagtgctgtttaagtgcagctaggatttccacaggaagacacttgcagtgaacagagttatggagcagcaaaaacacagatctatttggaaaaagagaaaacatatgcgttgtattttgcttcaattataaaataccatcctctcaaaggtggttctaaattacaa

SEQ ID NO: 230 - DNA, 300 bp, Homo sapiens
tccttttaggtaacacaaagttccaagtatgttacctagtttacagagtggtactcaagaagagaattaacattcttactgtaaaacttcattgataacaatagtctacttctagaaacagaaataagaattaaaaacagtgctatctatttgtactggtgagtgaattttaacttttaagaaaattttaatgtttaagaagaacttcagtgtatggagttacaagctatcctgaatatttttataatagaaagtattagttttcccagtgtggcagcttcttaataaaagaaattattc

SEQ ID NO: 231 - DNA, 300 bp, Homo sapiens
gaactaatgaaaagtggttgtctctaaccttggtatgctttcagagcatcagggttaaattacctcaacttttggcaggtatactctaaagctattaagtatataatatgggctcggcatggtggctcacacctgtgagccacctagcactttggcagtccaaggcggacagatcacttcaggtcaggagtttgagaccagcctgtccgacgtggtgaaaccccatctctactaaaaatacaaaaaccgagcgtggtgggtggcatgcacctgtggtcccagctacttgggaggctgagg

SEQ ID NO: 232 - DNA, 300 bp, Homo sapiens
gagacctgcagcccctgtttcgtggcagacagcaggtgcctggcggtgacccacggggctcctggcttgcagctggtgatggtcaagaactgactacaaaacaggaatggatagactctatttccttccatatctgttcctctgttccttttcccactttctgggtggctttttgggtccacccagccaggatgctgcaggccaagctgggtgtggtatttagggcagcttaacagggggaacttgtccccatggtcagaggagacccagctgtcctgcacccccttgcagatgagtatc

SEQ ID NO: 233 - DNA, 300 bp, Homo sapiens
agaaggctcttaagacactcaataaatatacttattgaattagtagaacttttcccatgtatctcctattactacattaggatctttgttcccttagtgtgtctttagcctgtgctctcacaagctttgtggtgtcgtgtggatcacaggatcgtttaagataaagatacttttagctctttaattctggtattctattattggtacagggaacccatacattatcttaatttcagagtaacacacgtctcggcatgggacagggggtgtcctaatgaaaagagggctaacaggtggaat

SEQ ID NO: 234 - DNA, 300 bp, Homo sapiens
ggaagggttaatattctcatttttccctcctattctatctggagagatcataaaatacattacagttagagtcaacaatcaccacttgaagaaatctcttcaacacaaagcctgataaaatttacatctggtaaatgtctatttaagctactgcgaaacacatatacttaaaaaaaaaaggccttttcattgtctcaatgtcttgaaggctggagattgtaaagcacttccctaaagttcctatgagcaggatgaggctatttgcctttatagagctatagaactaataagcaatcaaag

SEQ ID NO: 235 - DNA, 300 bp, Homo sapiens
ggacattatatgtctgaattttcacagtacctttaattaaagagatatctttaattaaagtagctctgtgaacagcaaggaagtggatgaggaaacagaaattggcagagtccatgatttgtccagattaaactgccatgagtgactgtaacaaaaattcagaacttatgtaactcaaataggtatatttgagaaataggtcggcacaggtcaagatgtgaaagcccaataaagctaggcagagacttggtaagataaaaaaaaagtgcctcaaaatgttcagtgacagtagtgccctga

SEQ ID NO: 236 - DNA, 300 bp, Homo sapiens
ggtatcagaagccaagccagagctcaggtgttttgattcacagccctttataaccattatcattttgaatgaaaagtaaatcactgtttcttagtgatttgggcatgtttcctgagttaagggatctgtctgacatccgtggtaagccttgtcttaagtgaattgtgggtaaagacttgtcccagatggagtgggaggacatgaaggatgaggaactaccttcaggaccttccagtccataggcagaggtgggggaaattcacagaaaaacaaatgagttaaagggatactgcagtagtg

SEQ ID NO: 237 - DNA, 287 bp, Homo sapiens
  misc_feature (1)...(287): n = A,T,C or G
gtacagcaggccttgatttcaacaataaaatcccgacctcccttgctgcgctgcactgcccccgggagctgatgggttggagactggaaatcagaaaacacacaatccagaaacatggtttatctggaacctaggtatataagatgccaagataagtcaaattcacagagacacattgtagaatggtgattgccaggggccacagaggagggcagaaataagttattcttgaatgagtacagagtttcagggttttttgtttttgtttttttttttttntttaaaca

SEQ ID NO: 238 - DNA, 300 bp, Homo sapiens
cctcggcccttgcccagggtggggcctggccctcatcttgaccaaagctgctgtgtggcagctcggcctctctacgaccccatcttggtggctgcacacttttcctggcccgcacccccatccccagtccctgttccccaagaggatacagagcacggtgctggctgactcaactgtgcgtcccaggttcagggtcttacagagctccaccccctggggtcttacctcactgggaatgtgttttgaaaatgaatttggagacaagccaacaaaccctgcactccaaaaaagcaaaacaga

SEQ ID NO: 239 - DNA, 300 bp, Homo sapiens
gggcatgtacaccctgctggcgcgctgcgaggagctggagcgggctctgcagccggttcaggggctggcgcgccaagtccgggatatccgacgtactctggaggtgttggaggccctgtgcaagtgaccaggaggacaggagaggccggtcctggccagggcagggcccagcaggaccctaaggactcttcagggagtcctggtgggaagtgcccactgaggggaggcctgtgtgttggaggctcttccagatgcgttcagctggcccgtgcccactcgctgggccttaggctggtgtat

SEQ ID NO: 240 - DNA, 300 bp, Homo sapiens
gggaagtttgtcaatgacaagagcaggaagagcgagaaggtgaaggtgattgacgtgactgtgcccctgcagtgcctggtgaaggactcgaagctcatcctcacggaggcctccaaggctgggctgcctggcttttatgacccgtgtgtgggggaagagaagaacctgaaagtgctctatcagttccggggcgtcctgcatcaggtgatggtgctggacagtgaggccctccggataccaaagcagtcccacaggatcgatacagatggataaactgccaagaaccagatttttaaaagg

SEQ ID NO: 241 - DNA, 300 bp, Homo sapiens
caggagcatgttgcgtcgtcactagctgaatgagaaccttcgggtccaagtttcagcttgtgggtgttaacacctacaggcacatcgatccgattagaaaaagcagtggttgcaaaccttttcctggacggcttcctttccttgcctatattgataccttttcttctcggagatgtcgctccagtaaacctgcttctgactagctgcttctgaaatgttctggggcctcgaaccggccggtctggccacctcaatccagactggctgcacccgctgctcccgcgaggcctggattcatgc

SEQ ID NO: 242 - DNA, 277 bp, Homo sapiens
  misc_feature (1)...(277): n = A,T,C or G
ggcagatgtcacaacagaataaccacttgtttggagcctggcacagtcctccagcctgatcaaaaattattctgcatagttttcagtgtgctttctgggagctatgtacttcttcaatttggaaacttttctctctcatttatagtgaaaatacttggaagttactttaagaaaaccagtgaggcctttttccctctagctttaaaagggccgnttttgctggnntgctcaagggtacnaatnggncnttaatngnatattaccgnanantgcctta

SEQ ID NO: 243 - DNA, 291 bp, Homo sapiens
  misc_feature (1)...(291): n = A,T,C or G
atgaagtcagggcaggccggtgccctttttgggaggcaccaggcggggaggagttggcggagcaggtctggctgtgagccagcaccaggcaacccggcccttgtccagggacctctgctgccttctctctggggtcaggaacctcagaggaggtggctctggctactgcataggacgcantnactngnanntgccgtnntncctgtctnattttctgtanntnnntncnncccttnttttntnctttnctttnttnnganttnntnttcnnnnttntnntanttttattct

SEQ ID NO: 244 - DNA, 300 bp, Homo sapiens
ctcagctctcaccagctgtcagatgctgccacagggcgagaacctccaagatgtgctccccagggacatctactgccgcctcaagcgccacctggagtatgtcaagctcatgatgcccttgtggatgaccccagaccagcgcggcaaggggctctacgcagactacctcttcaatgctattgccggaaactgggagcgcaagaggcctgtctgggtgatgctcatggtcaactccctgactgaagtggacattaagtcccgtggagtgcctgtcttagacctgttccttgcccaggaggc

SEQ ID NO: 245 - DNA, 300 bp, Homo sapiens
gttgatgagaagtctaaagcagtaatagtagaattacatttcttctggttttaatagtaattgttgtctgctgccttcttgcagtttaccctacccatagtgtgtaatgccattaaaacgaagtatagaaagatccattggcctggagaaaggttagaggtgtaggagtgtatgacatttagttcattgttcttactgggttcagcacattgcaccctgcgtgttatttgcaacttaaaagggtatagattaaaacttgtgctcagtgtaacaactcagtaccacaaaaatggtagaatg

SEQ ID NO: 246 - DNA, 290 bp, Homo sapiens
  misc_feature (1)...(290): n = A,T,C or G
gttacatcaagagataaatagagtgaagcagaactagtggtgcggaccagctcgccagcaacagaagggtttgtagtcggcctggcagtggacagggaggttggctagaactattaccttaggtccgtgataatatccctgaatccaacttttcagaaagaaataggtaacatatttttcaccaggaagctttacccagacactgaacagaatggtctcagtgcactaatggaggctcagttaaagggttgtggatcncatggaanagannttctganttggatatttgg

SEQ ID NO: 247 - DNA, 300 bp, Homo sapiens
tggagaggccttggcaaaatggctcatcacgttcaggccctccgggctgagttgtcagcagtatcaagggaggggcctgctctatccccagaaggatcaggatcatatccaggatgccccacatacaccaagccaggcagagggcagctcagctcctgtcccatctgctttggatatctttacccaaaggcaggtaacccgaagagccagcctccactgcccacagagccaggcccagttgtgttggagtataggtcaggagctgtggaaggaggcagtctgtgagggactcatgcttta

SEQ ID NO: 248 - DNA, 300 bp, Homo sapiens
tctgggagctgattggagaagcggccaagagtgtgaagctggagaggcctgtccgggggcactgagaactccctctggaattcttggggggtgttggggagagactgtgggcctggagataaaacttgtctcctctaccaccaccctgtaccctagcctgcacctgtcctcatctctgcaaagttcagcttccttccccaggtctctgtgcactctgtcttggatgctctggggagctcatgggtggaggagtctccaccagagggaggctcaggggactggttgggccagggatgaata

SEQ ID NO: 249 - DNA, 287 bp, Homo sapiens
  misc_feature (1)...(287): n = A,T,C or G
cttcagcgtagctctccacctctacccggaacacaccctctcacagacgtaccaatgttatttttagaatttcatggatttagttatacataccttaatagttttataaaattgttgacatttnaggcanattnggtcaatattatcattgaatantttgagacgnnnnggtgttntttttatnnttnnanggnttnnngttatnnnannatttnnggtnttannnaatngggggggngtnnannggnatattggngtgannantaattagggnnttttttgtgtag

SEQ ID NO: 250 - DNA, 259 bp, Homo sapiens
  misc_feature (1)...(259): n = A,T,C or G
agtcagcattatttaacactccccttaactgtctttgaactttctcttttaacaaaaatgtcaagtctttacagttgtaatatcaccatgtttcccatttctgttaatacttctatgaacccctaaagtattgaagggaactagntgnngncnagaggatcacanncnnntgtntnntanngncaanatntgcnanaacagttactngnnctnnnggnatgngnnncctnnagtntnngagccnntgcnntncatgttc

SEQ ID NO: 251 - DNA, 257 bp, Homo sapiens
  misc_feature (1)...(257): n = A,T,C or G
agtgctcggctgctgccagctgctcccaatgtgccgatgtccgtgggcagaatgacttttattgagctcttgttccgtgccaggcattcaatcctcaggtctccaccaaggaggcaggattcttcccatggataggggagggggcctgtnacgngctgcagngacaaacntangccgntggganttangnntntttcantcattntangntgnnataannnccataannnctngnatnngtatnnnntnactnncnt

SEQ ID NO: 252 - DNA, 300 bp, Homo sapiens
caagtgccgagacccgaccctgggcgtggtgcatcgaggtagatgcaaagatgctggccagagcaagtgtcgcctggagcgggctcaagccctggagcaagccaagaagcctcaggaagctgtgtttgtcccagagtgtggcgaggatggctcctttacccaggtgcagtgccatacttacactgggtactgctggtgtgtcaccccggatgggaagcccatcagtggctcttctgtgcagaataaaactcctgtatgttcaggttcagtcaccgacaagcccttgagccagggtaactc

SEQ ID NO: 253 - DNA, 300 bp, Homo sapiens
gctgcagcaactgctgctgccattgcaaccgcagctccgttgataaaggtgcagagtgatttggaagcaaaagtcaattctgttacagaattacttagtaaattacaggagactgataaacacctgcaacgtgttacagagcagcaaacaagcattcagaggaaacaagagaaattacattgtcatgatcacgaaaagcaaatgaatgtgtttatggagcagcacataaggcatcttgaaaagttacaacaacaacaaatagatattcagactcattttattagtgctgcactcaagact

SEQ ID NO: 254 - DNA, 300 bp, Homo sapiens
gggaaaacaaaaggtaataggaggggtgctgggagaacaaataggaagaaaagggaaaacccagaaatagtaattgttagtacccctgctacttgactgttgaaaatgctttaaaagtttgttctgaattaggagaaaaggcgctccctcaaccaggctgaaactaccaccagtgttgttgccagaaacctggagcaggaaggagctgcttctcccctccgccttccagtcacccaccattaatacctgctattggcaaggcccatctggatggcagatggcaaagcagcctggaaagtg

SEQ ID NO: 255 - DNA, 300 bp, Homo sapiens
gtttgagctcttgagccagtgacttccctgcacgttcagctttctcctttgtgaaatggtaatagaagcacgctgcacttgggattcttgtggattacatgtgagggtcttagaaacacttgatgtgtaagccaactattatgtattactgtatatggaacacaagggatgtagccaaaactaaatgcaagtttgtgcctcagatgtcttcctatcagaacagagtcaaatccagattttgatgcttaaatgtgacagcttattcagatttagaaaaacttttggtatgggccaaagaaa

SEQ ID NO: 256 - DNA, 275 bp, Homo sapiens
  misc_feature (1)...(275): n = A,T,C or G
agcactgtgagtgaaaataaaaccaggagcagggttagcatatctggattttagtctgagctctttgtcaaaaaagtcctgggcctcagtttctttattactgaaggagagaatcaactctgtgattctaagttataaaccaccgttattaaagttctactggagccaaaactccaaattgttctgtatattaaaacttttcggcagggcatngtngcttacacctgtaatcccaatactttgnnaggctgnggnnnncntatcncatgtgccca

SEQ ID NO: 257 - DNA, 300 bp, Homo sapiens
ctgttcactggcacacaatcacagtgtcttgatagtttttctggttttgaatttctggaagggaaatcctccttctgaggagacttcactttccgtcagtaatggggaaaactgtttccctcgggatagcagaggtcattttaaaagagaacactcagcagaaatgaaaatccaaacaactgatttttaattcgtgtctctttgttcagtgatgttggtcctgattctgcctatgagacgggaataaagagagatttcgggaaaagtgtgaagccaaacatgggtgctatttaaatacca

SEQ ID NO: 258 - DNA, 300 bp, Homo sapiens
gtttctttcccatctgccttttcctgtctttcagaacatttctggggtgttgtttgggctcagcactgtgggaagtgaagcatttagcctagccagggactgggcattatctgtcagattaccaaatcttgagttatctgtggtctacaaaagaaaagaaggctgaaggaaccagacagagggacagtggcctgggaacagagccaagatgatcatgttttttaaccaaagcctgtagatcaccgtcaagaaaggaatttggaggataggagtatctacatgtagtgggggaggtgtggg

SEQ ID NO: 259 - DNA, 300 bp, Homo sapiens
ctttacatcatctattctacctccattcactggtcaaagaagcgcagagttaagttggccagtgtggcgtggacacagccaggcgcagaccctcctgccagcgaagccagcgtgaggtctgttggctcaggggtccagtccctgggtccccgaagaggtaagccaaagacatagtgatacttggttcaattcggctccagagagtatcagatgggaaatagatgacttgttttacctggtcaaataagacatcactaaaatctaccatgactggaaattacttaatgcaaccagaggaga

SEQ ID NO: 260 - DNA, 300 bp, Homo sapiens
gacatttccaatagctcctttgtgaatttccagatatgggattttcctgggcaaatggactttttggacccaacctttgactatgagatgatcttcaggggaacaggagcattgatatacgtcattgacgcacaggatgactacatggaggctttaacaagacttcacattactgtttctaaagcctacaaagttaacccagacatgaattttgaggtttttattcacaaagttgatggtctgtctgatgatcacaaaatagaaacacagagggacattcatcaaagggccaatgatgac

SEQ ID NO: 261 - DNA, 300 bp, Homo sapiens
  misc_feature (1)...(300): n = A,T,C or G
cagggatgtgaggctgctgttgggggtggggggaggggaatgggcaggcaagccagtcttctgtcttcctttgctaacttagggttttgagcaggttggggtatggtgcctgacatacccacctgccaccctgggaacctcactgatctctctttcagcctacacctgctgatccatgatgtgtgtgaattgagggtgtatganngnnctncatcaaccccanagatnaataattcttctatcaataatcagntnttacnactnaatgccattcgnattcttgntattcacaaaagatct

SEQ ID NO: 262 - DNA, 300 bp, Homo sapiens
gcactcggtaaactctgggactggagccaagagactgtgagaaatgacctttctcatcaagtttgtcccaagccaggcttaaattgatagatcgtctaggttttctgatgctggtaaagagactctgtgcctcagggacaggtctgcaaagatcattaagaaacagattaaaattagggagcaagacaagacaagagaaagtttctttacgttctcccagacctctctgggcctataggcagatcaaatttggcctctagatcagcttggacaaaatgatgtccacggtgtctgagtagg

SEQ ID NO: 263 - DNA, 300 bp, Homo sapiens
cagaggtgaagtgatgtgttcaaagtcacacgtagaacaagtggtggaacagacccaaccagtctgatggcagagcctgcctctgaccactacactgtcctgccaactaagcaggtttgaaagagctctcttagtaaaagccctgcaggcgggagtgagcagaagttgttggtatcccagtgactttttgaaatgcacaggataagggagggtggattttccaagccatggtaaggcagcatgacctgacccagggtgagggagagggttcatgatgtaaacctcagagtagctagtcac

SEQ ID NO: 264 - DNA, 300 bp, Homo sapiens
gacacccagaggcagggcatcgagcgcctcaaacgaaagaaccagcccagggagcacatggggagctggcagtcagtaaaggagacctttggtggggacttctccctgaactggttcaaccccttctccagaccgtgtcagccagagatccccagtgacaaagacatggtgcggcaggtgacatcgctgtcagacaccgaaacaatggaggatccatcagaggagacaaaggacgaggactctgtggaggtgacagatgaatagatgctgctgtggggagagaagcaaacactaaaaagt

SEQ ID NO: 265 - DNA, 300 bp, Homo sapiens
ataaaacaggaattttggagcgggttgaccgaaggttagtgtacaaatttggaaaaaatgcacacgggtggcaggaagacaagctatgatctgctccaggcatcaagctcattttatggatttctgtcttttaaaacaatcagattgcaatagacattcgaaaggcttcattttcttctctttttttttaacctgcaaacatgctgataaaatttctccacatctcagcttacatttggattcagagttgttgtctacggagggtgagagcagaaactcttaagaaatcctttcttctcc

SEQ ID NO: 266 - DNA, 283 bp, Homo sapiens
  misc_feature (1)...(283): n = A,T,C or G
aggatccaatactgcctttcaataatataccaaaatactagttttataaatgttgttaaggtggactggaaaaactaatacatattttgaagtatttctctgatttattgaggatatgatgggcaaaggcaagctttctcgtaggtattatgagagcagacagatattttagtgtgtttgttgacatgagagagtcattggcagcgcagggaatagagagggaggactggtctgattatctggcaatgggaaattgagtttagtacgganaattgagaggata

SEQ ID NO: 267 - DNA, 154 bp, Homo sapiens
gaggaccgtccctctcctccccctttccctctttcggaaaggggtttctgcggggcccgggagcctcggagtaccgaacctcgatctccggggcggggtccttggtggggactgaacgccccctcccggggacgggcggactggccgcggagta

SEQ ID NO: 268 - DNA, 300 bp, Homo sapiens
tgagtcttcaaaaagtatcagaagagaaccaaaatgctttatgacaacagcagagcttgagcatcttgagaaccaactttgcccaagaatattgattagtagtttctgccatggtcacaggaaaggagaatttagcattttgtgtctctgtgtgtcatacctgaataagagtctattggtgcaaaagagcatatccaatagtgatattcataaaataagtgacgcaaaatagtccatgcaggatgggcacagtatttcaataaaatacaggtagttaagtaaaggtaatttctagttgag

SEQ ID NO: 269 - DNA, 294 bp, Homo sapiens
  misc_feature (1)...(294): n = A,T,C or G
aaaacaagggaacagtgtgtaaggaacttgtgcacatcactgactggtaccccactctcattttactggctgaaggacagattgatgaggacattcaactagatggctatgatatctggtagaccatagcgtgattgttataattttatacttttatagagcacttgataataaatgtatcctnatntctatggnttttatccgtacaagtgtgctgcattctantgntacattntnggtntanctatnagtaccttatnatantcnttcttnttntcataatttgntttctga

SEQ ID NO: 270 - DNA, 294 bp, Homo sapiens
  misc_feature (1)...(294): n = A,T,C or G
accgggaccagaacatgaccggctgggcctacaaaaagatcgagctggaggatctcaggtttcctctggtctgtggggagggcaaaaaggctcgggtgatggccaccattggggtgacccgaggcttgggagaccacagccttaaggtctgcagttccaccctgcccatcaagccctttctctcctgcttccctgaggtacgagtgtatgacctgacacaatatgagcactgcccagatgatgtnctantncttggnaacanatggcctgtggtaatgtnncttctgattgtgg

SEQ ID NO: 271 - DNA, 300 bp, Homo sapiens
  misc_feature (1)...(300): n = A,T,C or G
ggaaatttgggaagaatccaagaagtataggccaatgaaaacaagttattaatacaaatagtactgtatatgagagtacacattaggaatgctgtgctttaatgcataaacatgtttacagtggtccacatgtgccaggagatgtgggaatggctacccctgaagtcatatggagaaatggggtcctcatcgcacaccatacacanncatnatcnnacanatggnttanagacncttaagacctgannccaancaaacttctaggannanactcanggtanagcncnatgnnatttgttt

SEQ ID NO: 272 - DNA, 299 bp, Homo sapiens
  misc_feature (1)...(299): n = A,T,C or G
gcacgcccccttttctccgccacttcaccagtttctgaaatccaacctcccagacttcacaggaagatagatattcttgagataatgaaaagtgatatcttcgcatactaaaggaataaaggttgaggtatatatgatttttaactgtattaggggtgtatgaaccagtttaaaaacgaggttttatttactgtacagatgaatgcaaatcagaaccaatgatcccttggcctacttagttannaccngttcatacatcccttanggcttttattattattattattattattacagac

SEQ ID NO: 273 - DNA, 300 bp, Homo sapiens
cccacacctgcctggccaacccctggcactgatgatgcctgggtgcgggttaagctgggaggagctcctgcctgcctggatgaagaggaggtcaagactttgtcccccactccgcaagataccctctctgttccggagcggtgggtccctcccctgttaggaccttgtctccctcaggactggacctggatcctgggcctgcagtcagattgccagtttcacttagaggtggaaatgtcaacccactggttggaatgggaagctgctgtgttgtgagccaccttatggaaaacccatgtg

SEQ ID NO: 274 - DNA, 300 bp, Homo sapiens
tgtctttatttttttatatctcctaaagtaaaatctgagaatgacccaagaatatttgtttcagagggttgtctttttgttggcaagcagtgaagcacatgtaagtttctcaagctttagaatatatatatattaaaaaacaaaacaaaaaaaatgaagcacagacatgttattttcccagagccatcagtccaaagtatttcactgtattattagaagcaacaacttctaaacattcaactattccaaaaataagattttcctccagtaagttatcattctcacttgataataagataa

SEQ ID NO: 275 - DNA, 300 bp, Homo sapiens
attcgaccctggtgaatgatgcctataagaccctcctggcccccctgagcagaggactgtaccttgtaagctaaagctccatggaatagagattcctgaaaggacagattatgaaatggacaggcaattcctcatagaaataatggaaatcaatgaaaaactcgcagaagctgaaagtgaagctgccatgaaagagattgaatccattgtcaaagaaagaatttactgacaatgtgagcagtgcttttgaacaagatgactttgaagaagccaaggaaattttgacaaagatgagatact

SEQ ID NO: 276 - DNA, 300 bp, Homo sapiens
tatttactctggaaagtagtagcagcacttcaaggacataggggttgctcatgtcagttgtttctgtttgtattggaagaatcataataacaaatatttaagttggtaaattactaggtaaacaggttggtggattttttgttatttttgagaatactttttagtttgattctttgaatgaatttacataacagctttcctgtcaagtcagtaatttcacccatctttaaaaaacaagtaccaaaagagtttcttaacaccatatactcctctagcagctgctgcctagtttctctcctc

SEQ ID NO: 277 - DNA, 281 bp, Homo sapiens
  misc_feature (1)...(281): n = A,T,C or G
gggagaagagccgccagcggaacccctgtgtgcaccaaccttccccagagctccggagcgccctctcctcacttccaggttttggagcaagagcttgcaggaagcccgcacccagcttccttctgaccttcagttcactttgtcgcccttggagaaagctgtttttctttaactaaaaataaccaaaatgctaaaaaaaaaaaaaaaaaaaaaaaaaaaaaaaaaaaaaaaaaaaaaaaaaaaaaaaaaaaaaaaaaaaaaaacnnncncnnntaaaaaaa

SEQ ID NO: 278 - DNA, 125 bp, Homo sapiens
ggagagcagggcaagggctcttgggcatcacatccagaggctgagggaggggagacctggctgtgttcgtggaactgaaggaccactttcgcgactagaccttagccagggggaggtgtgggagg

SEQ ID NO: 279 - DNA, 254 bp, Homo sapiens
  misc_feature (1)...(254): n = A,T,C or G
ctcctggtggcttcaaatttactttctcccactctgccagtgctgctaatggaacaaacagtaaatctgtagtggctcagataccaccagcaacttctaatggatcctcttccaaaaccacaaacttgcctacgtcagtaacagccaccaagggaagtttggtngnnttagngnattatncanntgatnnngangaanancaannaaatnnnttntnnngaatnngtttttttaanananngnttctnnttaaa

SEQ ID NO: 280 - DNA, 300 bp, Homo sapiens
gtgcccaaggcgcccggactcggcctggtcctggagagggtgcacttcgagaagtacaaccagcgctttggcaacgatgggctgcatgagccgctggactgggcgcaggaggaaggaaaggtcgcagccttcaaggaggagcacatctaccccaccatcatcggcaccgagcgggacgaacgctccatggcccagtggctgagcaccttgcccatccacaacttcagtgccaccgctctcacggcaggtggcacgggcgccaaggtgcccagtcccctggaaggcagtgaaggggacgga

SEQ ID NO: 281 - DNA, 300 bp, Homo sapiens
gctttagctgttagaaaggaacccccgtgacatgacacagacacacgtgaacacccagcccgccggtcctagcagccagctgtgaaagctgtgtcaagtcacgggggttcccgtgtgtctgtgtcatggatgcaatgcgggccctggaggactgtgcgtcacccgtcaaccagagcgtgcctccgggccagcttccctccaaggaatgagtggatttcatacaggatctctttattgcacagactgaatggctttacatgtttctaatgtgaattaggcatgtgaagcagtgggtgtcca

SEQ ID NO: 282 - DNA, 300 bp, Homo sapiens
  misc_feature (1)...(300): n = A,T,C or G
atacatggaagtctcaaatctgaatttttatccatctcaatatgaccatttctctctgttgggagctgaacagattaagtatatatctgccaggttgggaaatattttggtctatcttttcctgtcatcagaacttaatttaaaaaaattatcaaaggtcagatgtgactactacagtaagttggctatcataaagaatattccataaaatgttttatctgccatacaaaattactgggtttatggccggatgtggtggctcatgcctgtaatcccancagntcaggattacngggtata

SEQ ID NO: 283 - DNA, 300 bp, Homo sapiens
  misc_feature (1)...(300): n = A,T,C or G
gctgcttcggggactcagccagaaagctactgaggtgctgagcgccgtcctcaaggatctctaccacctgctgaagcacgtagtgtgtctggagcccgatgacgtggccaagctccatgcccagttggccctagaagagctggatgacatcatgaaaaacttcctgttccctccacagaagctggagaagaagatcatggtcctgccgtagacctggctccaaggacngtggaggaggcagncanggccaggnacccagagncgtgcccaggtctttcancaggtggcctgctgcctctt

SEQ ID NO: 284 - DNA, 300 bp, Homo sapiens
gctacacaacactgctaacttgactgtagctatgtaataacattagatcccctaattgtaattatattgggtttgcacagaacactttaatcttcccctcaccaatgtgaagtgaggaatcaggagtcaaactgtagaactaaaatttgacttcagtctagcgtttccttggtgtttttaggttgctttggtaagtttaggtttgctatatttctgattgcttagaattttgttttagccctttaaaatcagatcataaatatgaattcatacttctaaggaattttcttgctataagct

SEQ ID NO: 285 - DNA, 286 bp, Homo sapiens
  misc_feature (1)...(286): n = A,T,C or G
atctgtatatctttccttttgtttacaactgttaaaaaacctcaaaatagctctcttcaaaagaagagagattccaagcaacccatctttcttcagtatgtatgttctggacatacttatcggagcgcgccagctaagngntcaagcatatanacattgtcngntggnanngnctngttnacagccactnnngcattggntncacgccncnggancncggtgnggctctnncncntantnccntnnntntgcnnttaccncctcnnnnnnncnntatntggccttc

SEQ ID NO: 286 - DNA, 300 bp, Homo sapiens
ccaacctaaaatatcattattttcaatacttaaatattagcccatcattttttatcttcagatgtctataattggaagcctatatagaaatggttgatgagcctatcggttgaaccactgcagagaatagagtgatggtcttagggcatcctgtactttgcatgctcctcctggaagtaaagagtaagacagagaatagtaataatcacccattccagaactggttgcacaacatcacaaaagcttgtccagacttattagcaagttaataaaaaactagacttctttctaagtacttat

SEQ ID NO: 287 - DNA, 300 bp, Homo sapiens
ggtgggtggcagagggaaatccaacatgcagactgtggcagtgtcttgaacttctgtttattcaggtcattgaataagaaactcttttcttctgcattcctgtctttctgcatgtgtgtgtgtgtgtgggctgggtagggactgtttttgagatcactgggctgaaatgtattctaggggtgaaggatctaggatgtacctgctcgtcatttcctgacttcaccttttaccaattcttttcttaacaaatttaaaattggtcagagcaggagctgctagctggctttttaacagtgtttc

SEQ ID NO: 288 - DNA, 300 bp, Homo sapiens
gtcacatcctcttaagtcaggaactatctgtataaggaaacaagatttccattttatcatttgaaatgtatttgactttgtttcactagttgcattatccccatggaaaacttcacattgagaacttaccattatatatttccataaaaatgcatgaaccatcccttagctaagtaaggattttgtaatgttctctcaataatgttgcttggcaaagttaatattttttgtatgctgatgaaatttagaaaagtccaatattgagcttgattgcaaacttagaaaaactcaagacttctc

SEQ ID NO: 289 - DNA, 300 bp, Homo sapiens
aagggaagcattccaaagattttcactgtttatgttcaaattacaacatgtgcagaaagttgtgcaactgaaaatcctttcaaacaacagctacaaaagagattggtcagttaggacaggaatagaaagtggaaacttagaagactggctactccttgtgtatgattgctggggtgagtctgtgctgagaactttttacaaagggtgtcctttgctgatatgagaggggggtgtcaaacttttgagtgatcactgtgggtcctcagcttagacatcttctctggcccaagatggcacccc

SEQ ID NO: 290 - DNA, 300 bp, Homo sapiens
ttgcttcggtcactagcccaggagacatttccccacccatagacctagtcaagaaagagccttatgggctttcaggactgaaaagagcttctgcttcttctctcagatccatctctgcagctgaaggaaacaagagctacagtggatctattcaaagcttaacttctgtaggttccaaggagacacccaaagcttcaccaaacccagacctgcctccgaaaatgtgcaggagattaagactagacactgcctcaagcaatggctatcagcggcctggctcagtagtggcagcaaaagctc

SEQ ID NO: 291 - DNA, 300 bp, Homo sapiens
cgcgctttgaaaaaatgagatcagcaaaacgcaggcaacagacctaatacatttcaaaacttgatatttcattttgcgttttagctagagaagttttccttgtgacttactaatggctgcaatgccaatgattgtaagaaaacaaacaaatttatcatgaaattctccttgtcattttataaatgcctattttaacatcatttatggttccagagatgcatacacttttttctgacaagaaaaagtaaaaggtgatgagggcaattctgtcctactgtttttacaggcctttttcaaatg

SEQ ID NO: 292 - DNA, 300 bp, Homo sapiens
ctcaagcaaagttcctgtagacaaagtaacaccaagtactcttccagaagaggtactagattttgaaaaattccttcagcaaacaggagggcgacaaggtgcctgggatgattatgatcaccagaactttgtaaaggtgagaaacaaacataaagggaagccaacatttatggaagaagttctagaacaccttcctggaaaaacacaagatgaagttcaacagcatgaaaaatggtatcaaaagtttctggctctagaagaaagaaaaaaagagtcaattcagatttggaaaactaaaaa

SEQ ID NO: 293 - DNA, 299 bp, Homo sapiens
aacaacaaaaatctgaacagaaatgctctatttacgttcttttccttatctgtagtgttttaaagtcattaaacttaaaaatgatgttcaggagaagatgagtgtatttgcatagtctgtcataactctggtattattttgtacaaggagtgtgttagggttttcagttgtaaccatgcagaaaatctacaaaataaaagcagttgttaattagtcctttacaatcagaattgtctattttggaaatttatgaagtacttcagatgtaatttaagaaattgtatttgagccaagcgtgg

SEQ ID NO: 294 - DNA, 300 bp, Homo sapiens
attagaccaaaaaaatgggatgcgtgtgggacagcttttaaagtgtttgaaagattttgcattcaacattcaggctatcagtgactccttgagtgaactatgtgaaaataagcgtgacaatgtagtcctggcatttaaacaattgagtcaaaccttttatgagaaacttcaagaaatgcaaattcaaatgagtcaaaatcatttagaataacaccatggaaaactttcaagtctgattatgtggtatttatccctttgcaaggagagatataattaagcttacacaatgaaatggaaaaa

SEQ ID NO: 295 - DNA, 300 bp, Homo sapiens
gtaatcctttctttttcttctccctctttcctgctcttacttatacagttaggtgaatatgatgctccacttcccccacagatactcaaatagctctgactgctgaaatattggtatcttactgtcagcacataacttgttgctgtgttattgacattttcactgttttgaaatttttactgttatctgggtttgaatcccagctctcccaagcttcagttttctttcatttgtcaaatgagataaaagtatccacttcatagggttgttatgaggattaatgatgaatacaaaacactt

SEQ ID NO: 296 - DNA, 300 bp, Homo sapiens
gtattcagtaagtaccaactatggtgctaacgtgagttcgatacgaaaaaagctgagattcatctatatccattttagaggaaagaagtgctatgacctttccaaactttcatttctctatcccaaagtctcatctaaacagattttactactttatgatctatgtttaaagtccttgggataaaaagaacaaacccaagaatgaggagtcttacttctacacttttatgatttcttatattggcattagacataaacatgtctgagaggctgtctggtccaactgtctctggtcacttc

SEQ ID NO: 297 - DNA, 286 bp, Homo sapiens
  misc_feature (1)...(286): n = A,T,C or G
ggccctaatacactctttgccctgtggcctctcccttttccccccttctggttggaggagggagaagtggcaantgnngcncncacagannanctgactngttgactnccttatgctaccntgggtgactncatattgcccctnnatgattncaacaccanatatagcaaatgacatttacatgctatgaaaacatctattgggtaaaatcagatcttggatanagaaattctcgacttttatataannttttgntanacngnananacagaaanggnttaagtgg

SEQ ID NO: 298 - DNA, 166 bp, Homo sapiens
gattcatcttcttgttctttaaaagtcaaaaggctttttgacctttaaataactcttacatctggtcatcactgttgaaatgttctactaaattttcagagtggaaaagttttaggcttaaaactgactggtaaaaatagaatatttctttgtattgatttttcag

SEQ ID NO: 299 - DNA, 300 bp, Homo sapiens
tgaaggtctacaacccagttagggcagaatggaggcaaatgaataatattcccttggtctcagagaccaacaactacagaattatcaagcatggccaaaaattgttgctcatcacctctcgcaccccacagtggaaaaagaaccgggtgactgtgtatgaatatgatattaggggagaccaatggattaatataggtaccacattaggcctcttgcagtttgattctaactttttttgcctctctgctcgtgtttatccttcctgccttgaacctggtcagagtttcctcactgaagaag

SEQ ID NO: 300 - DNA, 300 bp, Homo sapiens
gttaaccttttcaggctccaccatacccaggctcttaccttagcagaagcctgtgaagctggtagcagaaacgagaaggaacaaaattaactccaaggcagtaagccatccacaagaccactacacgaagttaaggctgtgtgaaagagggagtttatttaattttattgttaaagaggcaataaaatatctagagaaacagtccattaaaaaattggcaaatccagcctggccaacatagtgaaaccccatctctacaacaatacaaaaattagctgggtgtggtggcgcatgcctgta

SEQ ID NO: 301 - DNA, 300 bp, Homo sapiens
cgggagtgaaggcgcggaggcccgagaaaggataaacaagacaccgcctcatcagataagaacgtctccttcgatgtcacggatttcaagaggtagctggagaaactgacgtcaggagtgtcctgtgaatgaacatcgcccgaggcctagcacccacagaagaagggttctattttactctactttgcttgatattatttattttctaacaaagtgatccgtagtctgcaaccttaggctctgacaggcaaagcccatttcttagctctggggatggcttgcagggtctccacctctgtc

SEQ ID NO: 302 - DNA, 300 bp, Homo sapiens
gagttggtcaccgtggcccactatgacagccccgaggccctgagccacctctgctgccgcctggtcagtaggggaagcaaggtgaccgcaagggggtatgatcagcagcccacttgttccagggttcaccggggcccccaaccgtttctactgcagccaaaccagataggctactggtggggcaagtccaaggtctccgaccatgccacctgccctgggggctcccctggaaccccggcccctggattcagctctgcagcctcctccgcactcaggatcagccctcctgtcctgcactag

SEQ ID NO: 303 - DNA, 300 bp, Homo sapiens
gatacctgtgcctgacacatctgggcaaactgtggcactcaaagcagatgagaaaaccatgaaagaatccaggaggaaaacagatttctcacgaaggaaaggcgattccatggacagctcccttcttagtaggaactgtggaaaccagaagtagctttaaagtgctgggataaaactgtctttcaaggataagagtgaaaacaaagacatactcagacaaaaactgaaaacatttaccacaaacaaactcaccttaagcaggcaaatggccctcgatgtggaaagcaaagctcaggggac

SEQ ID NO: 304 - DNA, 300 bp, Homo sapiens
cctcgtcccaggaggccacccctgagaaagagtccctggctgagtcggcagccgcctacaccaaggcaacagcgcggaagtgtttgttggaaaaagtggaagtcatcaccggggaggaggcggagagcaatgtgttacagatgcagtgcaagctgtttgtctttgacaagacctcacagtcctggcttctccgccacccacacccttcccaccctgctgtggggccctgcctttgtggggagcagccagccctctgcccctgcccagggctccccaactataggcctgggacccccgccc

SEQ ID NO: 305 - DNA, 300 bp, Homo sapiens
tgttatttctcagcacgtatgtagcagatgaggaaatgaaggctaaaggtcatatatctacaaagtggggaggtcagactttgaacccacaacctgactgtggagccacttcagtatactctctccccataagaaagttccaatagaaaaaaaatgctacttaagtagggaaatcacaaaataagtgccaatgaacaataaatgttcaacctcactacagttaaaatgtatattaaagcaagagttgagatgacacttttccttataaaacagacagggattcagggacattgggactct

SEQ ID NO: 306 - DNA, 300 bp, Homo sapiens
gccatgtaccgggttccaaagaaaactaatttatcagactttgagctggaagtatccgaaaggcattcatgttgagactttagaaactgaaaagaaggagcgatatatagttatcagcaaagtagatgaagaagaacgcaaaagaagagagcagcagaaacatgccaaagaacaggaggagctgaatgatgctgtgggattttctagagtcattcacgccattgctaattcgggaaaacttgttattggacacaatatgctcttggacgtcatgcacacagttcatcagttctactgccc

SEQ ID NO: 307 - DNA, 268 bp, Homo sapiens
  misc_feature (1)...(268): n = A,T,C or G
aaaaagcattcaacatgcaaataggtggtatatgttgatatcttggcctgactggctgctaatttctgaatcaatctgtttgtgcatttaagtcatttattctctatttcaaaaagattgaatctattaaagtcttaagatctgtcttccattataatggtgaaagattttgaccagataagggaaaaganaacacaacagcttgattttgggaacncagatcttctcanagggggccactttacanagagattgntcaccnatngca

SEQ ID NO: 308 - DNA, 252 bp, Homo sapiens
  misc_feature (1)...(252): n = A,T,C or G
ataagacaccaaatcaaagtggtgatagtaaatatcattgccttggttctcacctcagagactagtgtttcaccattaagtgtgatatagcttagttttttataaatacttgggagtgaatttttaactgggtcatagaggattgttggatttcagcangtagaaatcagnggaaattanntctccagacacngggaagagacnctagtngnannncnnntggnntnctttggctntagattannggganat

SEQ ID NO: 309 - DNA, 268 bp, Homo sapiens
  misc_feature (1)...(268): n = A,T,C or G
gaaagattctcaaggaagaagtaataaggcattacatctgaagagtgatgctgaatttacaaagatatttggccttactaaggatttgagagtgtgccttactcgaattcctgaccatttgacctctggagaaggtttcgattcctttagcagnntggngannantnnnncnnnntnntgtcacnntnnntttgcctcntnnctnntntntcncnntcncntnnnnggntatngtcnncnnnnnatnttnttnnnnttnctcctcttt

SEQ ID NO: 310 - DNA, 295 bp, Homo sapiens
  misc_feature (1)...(295): n = A,T,C or G
ggagcggcaggcccaggcccaggagagtgaggaggaagaggagagccggagcaccaggacactagagcaagagatcgaacgcctgagagaagagggttcccggcagctggaggaacagcagaggctcatccgggagcagatacgccaggagcgtgaccagaggttgagaggaaaggcagaaaatactgaaggccaaggaacccccaaactaaagctaaaatggaagtgcangaaggaggatgagtcaaaaggtggctactncaaagacgttctcctacgncttttgcttaagtat

SEQ ID NO: 311 - DNA, 300 bp, Homo sapiens
aagagaagctatgaaaagcttcagaaaaagcaaatgagggaattcagaggaaataccaaaaatcacagggaagatcggtctgaaattgagaggttaactgcaaaaatagagcgcctcaccatgagggtcaatgacttggttggaaccagtatgactgtcctacaggagcagcagcaaaaagaagaaaaattgagggaatctgaaaaactattagaggctctgcaggaagaaaagagagaattgaaggcagctcttcagtctcaagaaaatctcatacatgaggccagaatacaaaaggag

SEQ ID NO: 312 - DNA, 300 bp, Homo sapiens
cccatcctatgggttgtcttttgactttttggttagtgtcctttgaggcacgtaagttttttaagtttttctctgttttttagcatcatatctaagaatctactccaaatccaaggtcacagagatttaccatgtgtttttatctaaaagctgtatagttttagaagtcagttcctctgtcctaccagccacatttcagtgatcacatgatgtggctgatgtccacagcacttgtcagtgcagataaagaccatcataacagaaagttcttttgcaaaaaaacaactttttttttttttg

SEQ ID NO: 313 - DNA, 300 bp, Homo sapiens
gaaagaaaatattttcacatgtatctagcagcaatatagtttacaataaaccctaggtggtataatgtgatgtacattacacatgaactatctacactcactaaaagccattatttaagagtaagctcacatagcacacctatttccttggtgttgcaaagcttgaggttgcacagctttctcattttgtagagcaaatgacagttttcatcaacagaccaatggattcacagctaagaataagacaacttgaaaactccacgttttacaaaatcattttctattaaattataaaaacct

SEQ ID NO: 314 - DNA, 262 bp, Homo sapiens
  misc_feature (1)...(262): n = A,T,C or G
acctcaaaaaaaatgctgatatcctaaaatattcctagtatcctaaaatattccataaatcagatatcctacaaagccaaactggtccttcttgttaaaattaataagattctataagctgttaaccaaaaaagtttccactaacactgnatacttanctctcctaantacatnnatttangcttgctgnnantnntannnggnccntnnttgnnnnnacttgncncnnagctattnnncacnatatccngtgnntnagtnc

SEQ ID NO: 315 - DNA, 300 bp, Homo sapiens
gctgttgcacttgccacgttatcttggagcctcgggttccccgcgtcgcctgtggtggtccccgtccctcgacaccatctcctcggtgggctcttggcgtggtcggtcctccaagtcctcggcccactggaatcaggtagtgtcagaggcggagaagatcgtggggtaccccacgtccttcatgagccttcgctgcctgctgagcgacgagctcagcaacatcgctatgcaggtgcggaagctggtggcactcagcaccctctgcttaccacagccagggggcttgtacatgacagctgg

SEQ ID NO: 316 - DNA, 300 bp, Homo sapiens
ctagagcaagagatcgaacgcctgagagaagagggttcccggcagctggaggaacagcagaggctcatccgggagcagatacgccaggagcgtgaccagaggttgagaggaaaggcagaaaatactgaaggccaaggaacccccaaactaaagctaaaatggaagtgcaagaaggaggatgagtcaaaaggtggctactccaaagacgtcctcctacggcttttgcagaagtatggtgaggttctcaacctggtgctttccagtaagaagccaggcactgctgtggtggagtttgcaacc

SEQ ID NO: 317 - DNA, 300 bp, Homo sapiens
gagagtggctaccttaaaaatgcaaagttgaagaactgtaacctcagaggagcaactctggcaggaactgatttagagaattgtgatctgtctgggtgtgatcttcaagaagccaacctgagagggtccaacgtgaagggagctatatttgaagagatgctgacaccactgcacatgtcacaaagtgtcagatgagaattttaggggctggaggaagatgtaaaagatgaaaatgttttccttatcacttttctttctccacccactcagttgtctagaagaaataacactgtaaggaaa

SEQ ID NO: 318 - DNA, 300 bp, Homo sapiens
  misc_feature (1)...(300): n = A,T,C or G
tcttcagaaggtcaaagcaaaacagaatctgatttttccaacctagactctgaaaaacacaaaaaaggacctatggagactggattgtttcctggtagcaatgccactttcaggatactagaggttggttgtggagctggaaatagtgtgtttccaattttgaacactttggagaactctccagagtcctttctgtattgttgtgattttgcttntggagctgtgganctcgtaaagtcncacttgtnntacanatcaacccangnnttttgccttnnttcatgatgantnngatgatgg

SEQ ID NO: 319 - DNA, 300 bp, Homo sapiens
ctcaccacccataccctccgtcccccgccggcctaccactatctagacacctcctgccctctccatatggctccgcgggattgtttccctccctagcccgacttctccaataaacagcaacttcctgcttctccagcaagtcgcataagaagaactggaatcttgacactacaactcctgacaggacgcccctgcggcatccagagacagggaagccagtgctgctctgcatgttcagggcgagtagctgagagtctccttccggcctggatactgaggaaggtgacttagactttctct

SEQ ID NO: 320 - DNA, 291 bp, Homo sapiens
  misc_feature (1)...(291): n = A,T,C or G
gtgacttctgtggaaaaaaaattaattctttaccattgcagcgttctgccctaggtccaaatgttaccaaaatcactctagaatcttttcttgcctgnaaganaangngctnacangancagattgttatnctngaacagnactgggaatnagatcanttatgatnnntntancggtnattngcnccnttgtttanntattcnnnatacatgnttntnttaattataatnccacttttctanattattttgtagtcggnaactcaanactttttnnntcagtaagttgtta

SEQ ID NO: 321 - DNA, 300 bp, Homo sapiens
  misc_feature (1)...(300): n = A,T,C or G
tcttcagaaggtcaaagcaaaacagaatctgatttttccaacctagactctgaaaaacacaaaaaaggacctatggagactggattgtttcctggtagcaatgccactttcaggatactagaggttggttgtggagctggaaatagtgtgtttccaattttgaacactttggagaactctccagagtcctttctgtattgttgtgattttgcttctggagctgtggagctcgtaaagtcacactcgtcctacagagcaacccagtgttttgcctttggtcatgatgtatgngatgatggc

SEQ ID NO: 322 - DNA, 300 bp, Homo sapiens
gccacgtttgcaaaaatgcagcaaaaaagttacttagtctggctgtttagtagaatttacctctactcattcatcagcctctttatatatatgattttaagtcttttcattgcactgatcactgatacatacgaaacaattaagcaataccaacaagatggcttcccagagactgaacttcgtacatttatatcagaatgcaaagatctacccaactctggaaaatacagattagaagatgaccctccagtatctttattctgctgttgtaaaaagtagctatcaggtttatctgtactt

SEQ ID NO: 323 - DNA, 300 bp, Homo sapiens
agaaggtcgcctctaccttgcccagaacacaaaggtgctgcagatgctggagggaaggctgaaggaggaggacaaggatatcatcaccagggagaatgttcttggggccctgcagaagttcagtctcaggcgcccgctgcagacagcgatgattcaagacggcctcatcttctggctggttgatgttctgaaggaccctgactgcctgtctgactacacgctggagtactcggtggctttgctcatgaacctctgcctccgcagcacagggaagaacatgtgtgccaaggtggcaggcct

SEQ ID NO: 324 - DNA, 285 bp, Homo sapiens
  misc_feature (1)...(285): n = A,T,C or G
gcacctgtagtcccagctactcaggaggctgaggcaagagaatcacttgaacccaggaggcagaggttgcagtgagctgagatcacgccattgcactacagcctgggcaacaagagcgaaactttgtctaaaaaanaaancactgggcttattcatgctctgatcacatctntcgtaaaagcttaagctctntccggggtccgggttggccgtnccgtgnaattctggtnggccngnntgnggtctctgnaaatgtggctgncngctnagancnnnnactctgac

SEQ ID NO: 325 - DNA, 293 bp, Homo sapiens
  misc_feature (1)...(293): n = A,T,C or G
gcacaccctcccgtggtggctgttcctccctgtcacctgcctcctcatcatggaagggggggggctatgaaagccggtctcaaagataactgcatccttcattccaggaaagccctagaattagggcacattgcaaactgaaatatgactataattcttatgggaccaaatttaagcaatttttgtttttggctgaagagacaccaaaatattagaggacaaatatttttagatccatttaaggagttttgaagtgcctantangacctatttgncagtggngnnatttaatt

SEQ ID NO: 326 - DNA, 300 bp, Homo sapiens
ttgtgaaccagatgatgaaagtggctatgatgttttagccaaccccccaggaccagaagaccaggatgatgatgacgatgcctatagcgatgtgtttgaatttgaattttcagagacccccctcttaccgtgttataacatccaagtatctgtggctcaggggccacgaaactggctactgctttcggatgtccttaagaaattgaaaatgtcctcccgcatatttcgctgcaattttccaaacgtggaaattgtcaccattgcagaggcagaattttatcggcaggtttctgcaagtct

SEQ ID NO: 327 - DNA, 300 bp, Homo sapiens
gttgcactggtgcctcccctcgaaccgccaagcagaaaccggacctcacagctgactgggaactggacatgtggaagagctgctggctgcatcagggaacaggaggaggaagagggtcagggtggagaggaagatcagtcagtgggcacaagacagtcaaatgggcaaggcctgcctcggggaactagaaccttccaggatctggagcccgggagagccacactgtgggcttaatgtgaatagaggaacaagtgggtatctctgccaggcaccccactttctcctagtaacatgggctca

SEQ ID NO: 328 - DNA, 300 bp, Homo sapiens
ctggtcagggtttgactcaggaagctgagttccagcttgtttccttggcagcactgccaaagagttagaccaagctgcagcttttgaggtgaaaggggatggaagaaagtactgttacttttccacttagaatttttggactttgttcttaatgaataggttcattttcaatttcaaagcaaagtgttaacatttttgaaatttgtctcaattctaaaggccaaacttaaatatgtctcctcctactggggcatggagcaagttattcatcaaatacagattctcgcatggaaaagaaag

SEQ ID NO: 329 - DNA, 300 bp, Homo sapiens
aatggatgctcatatattgcttatggatattttggataccaaagtaggaataactgacattcagtattttaaagctggcaaacctgtacatagaaaatagatccccagacagtggtctatgaagagggcagttaagtatcaaatacttaattttcttgcctttttttcttaagtggggaaaagtttctagatctcttacacctctgacacaatctgttctaaaacaggcacttgtaatgttggggcctccttgtaaacggtgtttttgccctttactctctgggattacaggcgtgagcc

SEQ ID NO: 330 - DNA, 300 bp, Homo sapiens
gccaggctggtctcgaactcctcacctcaactgatcatctgcctcggactaagtgctgggattacaggcctgagccaatgcgcccagcctactttctataaaagtcgtcatgtctctgcccccaccccccgccaccccccacatagtctgtttcatttgattttccccttagtttagtgttttattttgatgtttcttcagatgccttgggatcattcactgttcctcatatttaagagcaaatgcttaaaaattcttagaaataccttcttgaaaagcctgcattcctaccacctctca

SEQ ID NO: 331 - DNA, 300 bp, Homo sapiens
tcgagaccagcctcagtaatgtagtgagaccccatctctacaaaaaaataaaaataaaataaaatttctaagtacttgtctatttgcagtttactattcttgctagaatgtatctcttcagggttttggggtttacctatgcccccttcaattttgggttctctcaaatgccagatgtatctcctagaactctttgggatttttagctctctaatacctttagacatttaaaaaatatatattttggatgttttagttatcttcagaggcaatgttaatccgaattatcaaggtagtcat

SEQ ID NO: 332 - DNA, 300 bp, Homo sapiens
gaaacgctgactctgcctcttagcccctgggttgaagccgactagagaatctcagacgtgcttaaccggtctgttgggcttccctgcccttttccagtcccaggtttcctttccctgctcccttcctgcttctaatttcagccaaagagaaagcaaagatttagaaaagaagggtaggaagaagctggaatttgaattggcaagagaagtttgaggttgtcttttctagatcaaaacaatttttaataggctgatgttcacatgttgcactttctaaagcccgtgcttgacctcctaagg

SEQ ID NO: 333 - DNA, 300 bp, Homo sapiens
ccatcatagagcatttaggttcttttcactttctgttgtgaataatgcaatgttgaatctgagttcattaagtgaagagtccagctgcacactgcaggcccagtctggatgtaggtgctcagatggttctctttgagacaggctttatcctttggctctcatttttttgatgagtgtacatggcatgagggacacagattccgctagaattcaaatcccacttgtgtataacctagggcagtgtgccacatctctgcacatctgttcattgtaaggattacatgtttagtgtatataaag

SEQ ID NO: 334 - DNA, 300 bp, Homo sapiens
ctgggaaggaataattcaatttgattggcagatatatataatacagtaggagaataatgggagaaagataaattgagactagaataggtagactttaaatgcctgtctggtttaggtatttgaactttcaaggtgtggtaaatgtttgagtaaaggaataatgtgtccaaagattattatggaattgtctctctgcatacctctatcgctgtttgtcacagctgtgttcttatgtgactgattcttcctgaagattagaaactcctcaaagactggttattagagcttattcttcattat

SEQ ID NO: 335 - DNA, 300 bp, Homo sapiens
  misc_feature (1)...(300): n = A,T,C or G
gttggaagttcctaattctttcctcggttaactgtgaaactctgcgtattgggaaggcctggcctcagtcatcaggccaggagaggtactggacgccgcgcacgcactcgtctgccagcgaggcccaaaggggaagcctagcggagctcagtgtggcagctgctggcctctgggccggttgtgcatctaatcatccaaaaaattcagctcanaacctgactaaagatagtactttaaaacatgaaggcttctattcagagaacttaactgaatctagaaaattcctgaaaagtagggaaa

SEQ ID NO: 336 - DNA, 300 bp, Homo sapiens
gagatttcttctaatggcccaataatatccttcagtctccccacctccaatatccaaagttctgtcaaggatcacatactacatttggttctttattatagactttttaaatatcgttgtataccattgtgattctatcgtctcctttaataaagaggagaaccagaaaaatgaaaggtcataagaggaatgaggtttggagaataggtgaaaaaaggcatcataatgtttataataatgtttgcctgttcagagaaacaagaatcacagataaagtcacttatatgtagataagagaat

SEQ ID NO: 337 - DNA, 268 bp, Homo sapiens
  misc_feature (1)...(268): n = A,T,C or G
gctaaacatcaaaaacagatctggtaggggcggggaaatgagggggaagaaacatangcgtgntggtgccnttatnctgcattannaactttanttcnatgtntgtnttnttntttcnttnancgnanccttttatttatnttttttcctttttctntttnttatttntttnntnttattnttttntgtntttntttnnttttttttnatgntntnantttgnnttanttntntttttttcnnttntttntattatctttnttacttt

SEQ ID NO: 338 - DNA, 300 bp, Homo sapiens
gggacccagtggacttcttcctgctggtggtggtagtagggatggtactcatgggcattttcttcagcactctgtttgtcttcatggactcaggcacctgggcctcctccatcttcttccacctcatgacctgtgtgctgagccttggtgtggtcctaccctggctgcaccggctcatccgcaggaatcccctgctctggcttcttcagtttctcttccagacagacacccgcatctacctcctagcctattggtctctgctggccaccttggcctgcctggtggtgctgtccataatgc

SEQ ID NO: 339 - DNA, 300 bp, Homo sapiens
gtcaccaacttgaaaccagcaaccatcaaggtctatgactactacctaccagatgaacaggcaacaattcagtattctgatccctgtgaatgaggataggagctggaaactcaattagtcctctgtgacattactggagggtggaacattcttctgtcgcttgaagcagaactcattcaatcaaataatttaatttctctgactagtatatgggtaacaaatgaatatgtctgaacctcagctataatactttctactacctttgcaaggagatgggataggaacaatcactcagaggag

SEQ ID NO: 340 - DNA, 300 bp, Homo sapiens
tgacaccaaatgccaacccatcccaaatttacaacatcgaccctgcccgcttcaaagatctcaacctggctggaacagcggaggtggggcttgcaggctacttcatggaccacaccgtggccttcagggacctgccagtcaggatggtttgctccagcacctgctaccgggcagagacaaacacgggacaggaaccccgggggctgtatcgagtacaccacttcaccaaggtggagatgtttggggtgacaggccctgggctggagcagagctcacagctgctggaggagttcctgtccc

SEQ ID NO: 341 - DNA, 300 bp, Homo sapiens
atcatattcaagttggcaggtttgactgttcctctgcaccagacatctgtagtaatctgtatgtttttcagccgtctctagcagtatttaaaggacaaggaaccaaagaatatgaaattcatcatggaaagaagattctatatgatatacttgcctttgccaaagaaagtgtgaattctcatgttaccacgcttggacctcaaaattttcctgccaatgacaaagaaccatggcttgttgatttctttgccccctggtgtccaccatgtcgagctttactaccagagttacgaagagcat

SEQ ID NO: 342 - DNA, 300 bp, Homo sapiens
ctggacagaagtctattctccttctcagcagcggtggctgcactgtgatgcatgtgaagatgtctgtgacaagccactcctttatgaaataggatggggcaagaagctttcctatgtcatagcattttcaaaagatgaggtagttgatgtcacttggcgatattcctgcaaacatgaagaggtgattgccagaagaactaaggttaaagaagcattacttcgagacactattaatgggcttaataagcagaggcaactgtttttgtcagaaaacagaaggaaagaacttctccagaggat

SEQ ID NO: 343 - DNA, 300 bp, Homo sapiens
gagctgatcctgcatcatgcccgggccagcgagtgcagggacgtggaggggttcaaaaccgagatggccatgctggtgacccaggccaggaagaacaccatcaccctggagaagcttcatgtgtccagccttctctctagtgtctttaagttgctgatgactcacaaggtaaagcttgagagcaactttgcctccattgtgtttgccatcatggtgttggaggggcttggccgctcactggaccccaaactggacatcctggaggcagcgaggcccttcctcctcacggcccagtgtgcc

SEQ ID NO: 344 - DNA, 265 bp, Homo sapiens
gtgacctctgtgtttctataactatgttaatgtgacctgtaaaacagttcacttctcaacaagtcagcttcctcatatttaaaatgagaagttgtcttgagtttctaaagatgtttaggctgcattgtcttgggcctgctcaggattttgacctctgagataaaagctggatttaaaaagccaatccaagccaaacacctggcattattagcattgttattccatcagatctgtttgttctgataaagaagctgggggtggaatt

SEQ ID NO: 345 - DNA, 300 bp, Homo sapiens
tgacatcaatgagttgaagtctactcctctcatggaggctgaagaaacatttgctgagcaataatagaacctgccacaattatgtttctgatggggtaggacgggtccttgcaggagtagagggtctgcctggagggcatgggtaagaatcatggctcatgatttgtgtgggacaagtggtcgcagagcagaggctctgggtaaggagacctggtttgagtttataaccagagacaggcagttcaccaactgagtctcagtttccttatctggaaaatgggaataatttgtcttctctgg

SEQ ID NO: 346 - DNA, 300 bp, Homo sapiens
gtaggacagcctttggtgaaggagacactttggagagcatggtgtgtgaaaacacttaaaggaaaattaaagggaattaagaggaaattgaagggaaggagtatatgagaagggttgctttgtggttataagctgaattttctttaatgtattttgaaagaccccggtaaagaaaggaatttcttttaattttgcagagaatgaggagttgtccaattaggtgttgaattgttcttccttggaactctcaagagaggagttgtgtttagagatagatttgggagctgtaagcaagtagat

SEQ ID NO: 347 - DNA, 300 bp, Homo sapiens
ctttagcaagtcactcgaggtcatggaacatgtttttgaagaaataatatcagttcatgaattctgtacctgtttcttgtcgctgaaggggtaagtgacatcagcagcatgttcattccttttcttgtcttctacctgttctccacaaaagtataaaaagccagaattgctttttgggttttgagatggcattgtcttccatttgcaaaaaacagtttataagacaaataataaagaaattgaaatgtttctgatggtttcaaaaatgtaaacataagccagagtagttatgtctcaaca

SEQ ID NO: 348 - DNA, 300 bp, Homo sapiens
gtttaaagaaaacatacaagggtatgacggagatatgattaggagagggaatgctttttgagggcagaattgccaatctgcttgtactttataagcctgttgattgtttagatacggtttagccagtttatagttaccctgggtgctgaaaggtatgctggatgatacctaaccaacagagaaccattgaatgccgttcaaaatggactgaagcatcagcaatgtctgaaaaaggcctgacagtaatgtacatgtcaaatggcccgtaatttaagcagagtagagtaagtagaagaataa

SEQ ID NO: 349 - DNA, 299 bp, Homo sapiens
  misc_feature (1)...(299): n = A,T,C or G
ggtggatgtcagagttcggtggcagctcccgtggggacctggggtgtgtggctgggtgaagacgatcacctcccttctgtggttttattccccaggctgagtttgagcccccaaggctcctgtcggttctggtttgtgattggctcctccgtgccccatgcgcatgtccagccgccagggagattaggcgtttgtagtaagtgatttcactggccctggggggacagatgggtagacagtgtttgatcccangtctttgcagggctctagcccctcgcaagcttctgcaccttctctgc

SEQ ID NO: 350 - DNA, 300 bp, Homo sapiens
gtctcatgttagttgtacccacagctctcatcagaagcagacacagatactttttgtaggaaaacatctctaacttaagcctgtaggattcccaaagattaaaagcaggcaaatatgaattcagtcaaatcatagcattcaagtagtctcaacccaacatatttgagaattgttagaaacaatgaatatgtttcccaaagactaggttttggaattatcagatacagaacacagacttcaaatattagaattgtgagaaaatagttacatgtcaaacctaatataaaagaaagatggact

SEQ ID NO: 351 - DNA, 300 bp, Homo sapiens
atgcttgtcagcattgccaagtggcaaaaaatacagttattgtagcaccgaaacagcaccttctcaaggtggaaaatccatggagtttagttactgttgatctgatggggccttttcatacaagcaacagaagtcatgtatatgctataatcatgacagatttgttcaccaaatggattgtgattttgcctctatgtgatgtttcagcatcagaagtttctaaagctattatcaatatatttttcttatatggacctcctcagaaaataataatggaccaaagagatgaattcattcaac

SEQ ID NO: 352 - DNA, 300 bp, Homo sapiens
  misc_feature (1)...(300): n = A,T,C or G
ctggacttgggctttttcttctatttgctgggtagaaaagtccttaaagtggatgctcatgttcagtggcctgggcatatattgtttcactggtatcaataatattttaggatataattttctagcagctaggttttacatgtatatacactatggttcagatataaattacccatctctctatattagcccagttagctagtacatggataagtcattagataatttgctacccatgtatntgtnctattaagangtacntatanttnaactaccaancnatntgtacnntgcatttat

SEQ ID NO: 353 - DNA, 300 bp, Homo sapiens
aaacaactgaaggtcaaaaacttatatgcctttttatgtgtacatttaataaaacaattttattgatttcttaccgtaagttactgtgatgagtgataaatacttcactattcagatactttcgtaagagatacatttcagtggaacactttgcataaatattttctcaaaaatgtgccatttctgggaaaaaagggaatgatgggaaagaatgttattgcagtttttcctagaaattttgtcagattggcatgcatttttattgactaagaatcccaattttagcatgaagaccattag

SEQ ID NO: 354 - DNA, 300 bp, Homo sapiens
gggaagttgttgttcaaatctgtagtgtgtccagtcagcacaaacgaggaaatgatggcagagttagtttaataaaacagagggaatctacgttaggtatcatgtatcggagtgaactgctttcttttatcaaaaaattacgagaaccactcgttttgactattattttatcactctttgtgaaacttcacaatgttcgggaggacattgtgaatgatattacagctgaacacatttctatttggccatcttccattcccaacctccagtctgtggactttgaagctgtggcaatcacag

SEQ ID NO: 355 - DNA, 300 bp, Homo sapiens
gggagacctatacctagatgttgctgaagcttttctggatgttggtgaatataattctgcacttcccctcctcagtgctcttgtttgctctgaaagatacaaccttgcagtagtttggcttcgtcatgcagaatgtttaaaggccttaggctatatggagcgagctgctgaaagctatggcaaggtggttgatctggccccactccatttggatgcaaggatttcactttctacccttcagcagcagctgggccagcctgagaaagctctggaagctctggaaccaatgtatgatccaga

SEQ ID NO: 356 - DNA, 292 bp, Homo sapiens
  misc_feature (1)...(292): n = A,T,C or G
ccaagctgaattccagattctgaaagctgagctggaaagaaccatagagganaagcaagagttaaaagagaaactgaaggaaacagagacacacctggaaatgctgctgaaggctcagggctttggcaaagcttacgcggctacgtatccacgtcagctatctccttacttctgtcctccctcacttggagcttcangagatcggctatgactcagaacaagtgnatgggatcctgtacacggngctggaggcaaatnacatactgnattgancaccagactgnataccctt

SEQ ID NO: 357 - DNA, 300 bp, Homo sapiens
gctaattggaaaatactggaagtcccttaggtattccactgcagtagtatcataagcctagaaaatctggaacaattctgtgagggtttagaaaaagggacattgaattcagtctctagcagtatggtagatgagactcaatgaacaatcttgtcacaaaccaaggacatcatctgaaaaaatgttttaagtcttttgaaatgatctgtcaagaaaacagggaatcatcagacaccaaaaccaaagtgtaagtagcagaggtcagtaagcactcaaggtggccccaccctggaggtttct

SEQ ID NO: 358 - DNA, 300 bp, Homo sapiens
  misc_feature (1)...(300): n = A,T,C or G
agcacaagagatgtaaaaaaaaaaaaaaaccccncccncngnggaangncccttttnaggtttngnttngtttttttttnggtttnnttttntgtttttttaatnntggggataacccntgatgncnggctanngtncatatcnggtcttttnagntagtgggctcttttaananntntnngctnaaannttaactnataaaaggttngagccncgtnancatncgncnaanggnacccangcataganaaaagganattcnnnccctgtgtatgaatgagcnggtcagattcaaggcag

SEQ ID NO: 359 - DNA, 300 bp, Homo sapiens
agtttgtggcagctggagatcacctagtccaccactgtccaacatggcaatgggctacaggggaagaattgaaagtgaaggcatacctaccaacaggcaaacaatttttggtaaccaaaaatgtgccgtgctataagcggtgcaaacagatggaatattcagatgaattggaagctatcattgaagaagatgatggtgatggcggatgggtagatacatatcacaacacaggtattacaggaataacggaagccgttaaagagatcacactggaaaataaggacaatataaggcttcaag

SEQ ID NO: 360 - DNA, 270 bp, Homo sapiens
  misc_feature (1)...(270): n = A,T,C or G
gttttctcggcagatctgcaaggctggctttaagagcacaaggagggaaagtaacgaaagggctggactactataaaagttacaaatacgtagttagaccaatagatttatatagtcaggtttttgtcatgtaatttattaactaactattacagaaacacagctaagaatatcaagtatttctctggctcttgacagaaaaaaatcagttgacttaaccctttgctgcanaanagttgncgtttctgcgttggntgctactgctaactg

SEQ ID NO: 361 - DNA, 152 bp, Homo sapiens
  misc_feature (1)...(152): n = A,T,C or G
ggtgcgttagcatctgaaccactgaaagtgagtgatggcttttatggtactggagagacctttgtttttacattctgtccggagtttgaggtctttaagtggacaggagataatatgttttttatcaaaggagacatggattcactancttt

SEQ ID NO: 362 - DNA, 276 bp, Homo sapiens
  misc_feature (1)...(276): n = A,T,C or G
tcatggtgtctgtaagtgatgacaaaagctttaataactggcacactagcataatatagaaatcaatatatatcaatgtaaaatataacccccttttattctgtaaataaatacacacaagcacatgtatattatcactgtttatagcacaaattatcactctaatttccaattttttaattgatttttggacattctgaagagtattcttgctactagctaaatgatctccatttccgggccatggtttgacatanggaaagncagccaaacctt

SEQ ID NO: 363 - DNA, 300 bp, Homo sapiens
gtatgccccttcagaacatgcagagtgtatctttttttaaatttctccttccgttgcttaagtattgcgcagatttgttcaactttgcaaatatggacatcactttttttttctttgagaaaacacttgtatcagctttgtggtgttttcagggagaccgctgatggcagtccgtgtaaaaacccagcaatgattatgcacgtggagacatgtgctttttatttcttagcaggatattttatctctgtacataaagtagaaaccaaaggctagggaaacagatactctttacaccatcat

SEQ ID NO: 364 - DNA, 300 bp, Homo sapiens
gtgagccgagattgcgctagtgcactccagcctgggcaacagagcaagactccatctcaaggaacgttaaaaaaaataaaaattaaaaaaaaagaatatttaggaaattggatattttctaggagaattacagaagaaaggtagtaaagaatggcaaggttatatttgtgaaagactttaatgtctagagaagagttgacactagggatttgggtaaccatcaatagtttctaagtaaggataaaattttatcactattattacaataagcacttactaacatgatggatattatgatac

SEQ ID NO: 365 - DNA, 300 bp, Homo sapiens
gtcactttactctccatccggagccgcttcctttctcgccgcgaggctcggggttggggggggaccagattggagccgcgggctaactgggatccgtcccatttccctgggcttgacgttctctgaatttttagctaatgtggaaagttacatttatttgcatttgtttatcgcttgctcacataggtctgtgtcccgaagcttggcagatgagcgaacttagccagcacacccccggccgtgaagcagggaggtgaagcggggagagcaacgagccccacccgggtcttgccagctgga

SEQ ID NO: 366 - DNA, 300 bp, Homo sapiens
aacacttttagttgctctattgattacttagatttttgttggcaattaggagcttttcagtaacattctttgctccatcggtagtctctgctggctcttgttcactcaggaaacacctgagcacagggcttcaggaaagccttctattaaatgggcagaggccccagcaggactcctgcatgttcatctgcacagccagagacagctggagggcaggaggagccgcgttcacatagggttctgcagccttggagccgccgtttcttccaagtactcttcagatcagcggttcttagccct

SEQ ID NO: 367 - DNA, 300 bp, Homo sapiens
ccagcacctgctgtgctgggaaggccgaggatgggggcccagcactgtccaggcctgctggggcctggctgggagtcctgtgggcagcatggaacatgcagctgggcttcctgtgaccaggcaccctctggcactgttgcttgccctgtgccctggaccttttcctgcccttctccttcctctgctcccttggggctaccccttggcccctcctggtctgtgcaaactccctcagggagcccccctgccctgtagctctcacttaacttcctaggggctgctgagcccacccagaggttg

SEQ ID NO: 368 - DNA, 300 bp, Homo sapiens
gttcttttgaacagtaacagtctaggatctttttttttctgagatgatttttgaatgcttttgtgtggaaccacatgcatcataatagatacaaatccatgaaagtataacagttaaatactagatcttactttttcaggttttgatttctcatctaaactttccaatgctttatcagtgaagcaaactaactcacattgactagcctgctctcctttagcaaacccttcaaataaatgcctcatttgctcctcaccactatcattttagattggccagacagttgttacttacctttta

SEQ ID NO: 369 - DNA, 300 bp, Homo sapiens
ccaaagcacacaaatggcctaccatcttttattcttccttctagcttctggagagagaaatgattgttccagtttagaatgccaggagtttactgggtgtttgtattttttatctgtgccttaaaaaaattagattataatgaacaagacatctttatgttttacagggaaggaaaaagcagtgaaagtatgcattttcgaaagaaaagtgtgttgggaaaagagagagagggtggaaacccaaaggagaaataaaaattttaagtccttgttgcagtagctggaggaagtgagcttgga

SEQ ID NO: 370 - DNA, 300 bp, Homo sapiens
agagtaaaaatagaaatgttctttttcccagaaaaaaaatcagtaagctggtacagataaccataccacattgcctgtttttccaaaaaattacatttgggtgatatcaaatgcaaatttttgaactgcattgacagaagtcaggcatgtttagagagttagtaaactttttcagaccacagatcagcattaagtgaaatactgcttcagccactgataccttcatggcagataagtattatactgacttctttttagagacacttctgttcacacacaagacacagaatttgttgaata

SEQ ID NO: 371 - DNA, 300 bp, Homo sapiens
  misc_feature (1)...(300): n = A,T,C or G
cgccatgttgcccaggctggtctctcctgagctcaggcaatcggccaccttggcctctgaaagtgctagaattacgggcatgagccaccgcatccagccagaaagatacatatctaattctagaaatagcatgcagtatcagtcatagtaacagccatgtgctgcctaaaataaaatttcttgaaatggggaattaaccctggagtattgagctagtttttttggtttggttttttggggctgaacatttgggcctaatcctttgnntnntnaaaccntttaaaaaannnaaggtttggt

SEQ ID NO: 372 - DNA, 300 bp, Homo sapiens
tttagatgaagtgctgagaatatttagaaaaagcgctttaaaaagcatctagagattatcatgaaaataattggagacaaagtcactaggctgctttgtgagaggcagcataccatggctctaaacccgttcacaaaaaacaatgttagagacattaggaattcaggttttgaaaatctttttttcgatttatttgtaatttacataccaaaaaaccacattaaaatagtcctcccttcaacatggctatcttttttcaagttttatatgcatagctctctcagcacttgaatggaaaaa

SEQ ID NO: 373 - DNA, 300 bp, Homo sapiens
ctgaaatgctgacaagatgtggcattggtaagttgctactctttgattatgacaaggtggaactagccaatatgaatagacttttcttccaacctcatcaagcaggattaagtaaagttcaagcagcagaacatactctgaggaacattaatcctgatgttctttttgaagtacacaactataatataaccacagtggaaaactttcaacatttcatggatagaataagtaatggtgggttagaagaaggaaaacctgttgatctagttcttagctgtgtggacaattttgaagctcgaa

SEQ ID NO: 374 - DNA, 296 bp, Homo sapiens
cttgtgttttcttaactcccccagtaatagacctaactgattttgttttgagaagttcggtattagcttaagtttttgttcgtttatagaatatcaaaatggtatcaaaactgtttaaaaggtcaatgtacatctgtagcagagctttttactcttttccttgtcttctttctctttgtgtatatacattgtttatagttgtattcagtatacatgaaattttgtgtcttttttactcctctctgtataaactttctgtgctgcaacaatgtaaattacattcaggttgtttccag

SEQ ID NO: 375 - DNA, 287 bp, Homo sapiens
ggtaaaaggtggagaccatcattgtggaatcttgtattttctattaaggtttgtaatagtcctacaaacttgaacataaatttttaatatttgggaaggaacattcactgaagaattgataatagactaaaaaataacctgttatcaattaatacatgatctgtccttgaacacatattcaccattatgtaaacctcacattatttcagcttatttattccacagataccaatagacatgttttcacattgtagcatctcccaaatcaaaatacttctaaaaattgg

SEQ ID NO: 376 - DNA, 300 bp, Homo sapiens
gactatgcaggtctatggggaaacctttagtctgctttaagaaaactcagtatctgaaaatcttaacttagcatgtgatactgtcttatcagcatctgcagaagtgccaaagccactgctagacacttaatgtgtattatttcatttaattatattttaaatgtgcttccttggtaattcttaagctcgagaaagagtttgagaactgctgctaggaaatagagattcacatttaaccctgtggtacttttaagaagcaggtacgttgttgcatatatacttgggtagagattggtaact

SEQ ID NO: 377 - DNA, 300 bp, Homo sapiens
  misc_feature (1)...(300): n = A,T,C or G
ataacatttttgcaagtctgaaattatttcaaaatcaaaagagactatcaaattacaggattaaataanattggattnttcccatancaatttaatgccatttaaaaacaatgttacatgattacttattaaaagaatgtgctngccgcttttctgctgtctggctgacttggaggcctgagattanatggtacccttgtgttctttnggtggtggttataancanggatcctcancatttctcttttttgnatcttgcnattccgncttcaagctattccccacctgcaccctcccctt

SEQ ID NO: 378 - DNA, 300 bp, Homo sapiens
ctcctgccctgcttaacccctctctgtgcctccccagtgtccctataacaaagcccacactccttggcccttgctaaaccttccgtacccctctcaaacctctgggaccccttccctggccatagccttgccctgtgttgctcccttggctgggaatactcttcctcctgctccattttgccaggccagttcctacccattctcatggcaaacatcccttcccaaaagacccaacgccctctccaggccaggtcatcccccagcctccttcctatgccctctcaggactctatagttctt

SEQ ID NO: 379 - DNA, 258 bp, Homo sapiens
  misc_feature (1)...(258): n = A,T,C or G
gggagctgcaccacaaacgtctagctctcagcagagctgggagcaaagcctggccgcccaccccaacctggggctgcctcccactccgtgagatgcttctgtctcctgttcactttgtgtggtagtttcttatttnccaatgcatctnattngatcattactgngaccttggaaatcnctatgntanggnnancnntnnagnngncntatattntaaaancttttgnatnttaagnctcntantttngtnntctggnt

SEQ ID NO: 380 - DNA, 248 bp, Homo sapiens
  misc_feature (1)...(248): n = A,T,C or G
cccaggcctccccgaaaccaaaggggaaggcaggggtggggccgtggctgaagccggctccccaaccaaaatgctgcaccaaagctcgggcgccgcgggcacggctgctgcagtctcttcccagcctggccctggcaaggggcgggtgggcgctgccaggcgggtgcttctcgacgcacttgctcccggaggctgcgccccggcgcctggaacccgangtgggaagaacngntngnnnnanccttgtt

SEQ ID NO: 381 - DNA, 300 bp, Homo sapiens
tcaccaaccagatgagcatcgggcgcgggaagctgccagccgaggagttcaaggccaaggtggaggctgtggtggagaagctgggggtccccttccaggtgctggtggccacgcacgcaggcttgtaccggaagccggtgacgggcatgtgggaccatctgcaggagcaggccaacgacggcacgcccatatccatcggggacagcatctttgtgggagacgcagccggacgcccggccaactgggccccggggcggaagaagaaagacttctcctgcgccgatcgcctgtttgccctca

SEQ ID NO: 382 - DNA, 300 bp, Homo sapiens
cattgttgtatcagtgggtgttgatgaagaaattgtttatgccaaatcaactgccttacagacatggctctttggttatgaactaactgatactatcatggtcttttgtgatgacaaaatcatctttatggccagcaagaaaaaagtggagttcttgaaacagattgccaacactaagggcaatgagaatgctaatggagcccctgccatcacactgctaatacgagaaaagaatgaaagtaataagagtagctttgacaaaatgattgaagccattaaagaaagcaagaatggcaagaa

SEQ ID NO: 383 - DNA, 279 bp, Homo sapiens
  misc_feature (1)...(279): n = A,T,C or G
ctgaagggaacccacccacgctccttccttcccaagagactgagcgggccatggagatcctcaaagtgctcttcaacatcaccctggactccatcaagggggaggtgtnggaggttntttatgttattttttnagntngtttntttntttttgngttntgttttttttttttttttttttttnatnttcttntttnttttnttntttntttttatnntntttttnnntcttntttttnntttnntttnttnngtnttttttttatttntttnttttttt

SEQ ID NO: 384 - DNA, 300 bp, Homo sapiens
ggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcc

SEQ ID NO: 385 - DNA, 300 bp, Homo sapiens
actgggtttttgttctgtgcctccagtatgtgcataggaaatgtgtctttgaatgatggggaagctgtggaaacgcactaccaaaaggaggtttcataccctgttcacctaattgtgtcacagaaatcagaaaaggaaaatctgtgtcagtgaatttcactgtatcgtcaaccctccagattgggggatctgtggagtcaaccaaccttggatcaaaaatatttggaaaaaaaatttgcattcatactgaacatgtacagactttcttttcttgtcactgttccataaaacaatacagtg

SEQ ID NO: 386 - DNA, 300 bp, Homo sapiens
gggaaaataacccagttttgatcttttttagtctgggtgcttactggatgtcaaggtagaaagtgtccaacaaggtgctttaactataggttgagttctcaaaaaggttaagagggtagagttatagtgacatcttcagcatatatagtagttgaggccagtggaaaatttcccattgagagctctgagaggaaagtattttagaagccaagggaaaaaggagtattgagaaagcgttagatatcacagaaaaattagattggtgatttctaagacaaggatataaccgttaggatgtca

SEQ ID NO: 387 - DNA, 300 bp, Homo sapiens
caaaaataatagaaaaaaaaacagaatttccacaaacccccacctaatttatctgcctcctgccatcagtgccaatatactgtgcttttcttctgtggatacattatttaggccactattcagggccaacccctccacctgcctactagaggccatcaccacttgtttattcaagggcacagctccaggtagttttccttctcttggggatcatcagtttccttctgtctaccaggtcattcccattagcatgtttttgccgcttttcttaagagataatatctcaaccctaattcctcc

SEQ ID NO: 388 - DNA, 300 bp, Homo sapiens
ggattatcttgatgatggtgactcattatcagtgctttggtacttttgattacctgtgtttcagtattagtgtcactttagtacttcagatcctgcaaatatttttgcagatgaagtatgtatgtatgttactaagttaaacttagaaacagaacctcattcagtttttataatgtatttttgcaaactactgtaaatagcaaatcaatgccaatgttaaacaaagaggaaaacgttgtgtggactttgttctcttgcaccggtatttcaggaacatctgcttgccatccccacagctct

SEQ ID NO: 389 - DNA, 300 bp, Homo sapiens
tttttattttgaaatacttggctgacttacaaaagacttcccctcacacttgacatgattgacaaaagctgtttgcagtgtttcctgcacgatgaacaccaggaacctgggaagtgagaagaaccctgggatgaagtcatcctgctggaatgacctggctttcaggctgactgccacccgccccatggggaacctatctccactgctatggccagctatttttttcgagccaggctctcgctctgttgccaggctggagtgcagtggtgcaatcactgcactgatcctcccacctcagcc

SEQ ID NO: 390 - DNA, 300 bp, Homo sapiens
atccctacctagaagagaatagatgggaagagaactgaaagaaagaattcctcaagcactgaagtcaggaaaatccccgtaggcactgtattagttgttccatttatcccagcactccacttgtggatgaaggagttgtatagaaaggagatgagaaaatggcaggagtggaagcagccaagaagagatcgatgactgaagatctccttcaccttcaggactgtctcaaggggttatttcacctctactcatgaggatggccagtttttctgtcttttatctttagacccatatataatc

SEQ ID NO: 391 - DNA, 300 bp, Homo sapiens
aatcagtcagatatgcctagatgaagaaacaaaatggcaatctgagtagaagaaataaggagaaaggaggagaggtgtgaaaaaaagtcctttttctgagaacaagcattcaaacagataaaacacaggtttcataaagaaaagttaaatgtcccactactatgagtcaaaatggtgcatttgctttttcctgggttttgatttattgccctctgtttgtaccccacattcgcatccttggcacagactgtcatatgtcacacattcagcctcctacacttccaccccacaatctcttta

SEQ ID NO: 392 - DNA, 300 bp, Homo sapiens
tcactgttgcagcctttttgaaggggacacagtctaggagggggataaatgggatgcccttgccccagagagaacccagttctaggtactgtctgggcctgggaggcgagagcagtgcccaggggacttctgggcttacaggacagcgtgtgtgacaaaattcagatctacctgaacttgcctctggagatgataagggccaaaggagcagtcagggaggggcggtgagccagagtagtcccagggggagacagattcctccctcctccccgcctgcagctctctttaattttttgtaac

SEQ ID NO: 393 - DNA, 300 bp, Homo sapiens
tcactgttgcagcctttttgaaggggacacagtctatgagggggataaatgggatgcccttgccccagagagaacccagttctaggtactgtctgggcctgggaggcgagagcagtgcccaggggacttctgggcttacaggacagcgtgtgtgacaaaattcagatctacctgaacttgcctctggagatgataagggccaaaggagcagtcagggaggggcggtgagccagagtagtcccagggggagacagattcctccctcctccccgcctgcagctctctttaattttttgtaac

SEQ ID NO: 394 - DNA, 284 bp, Homo sapiens
ggctggtggaagaaaggggcattccagactagagggagcagtaattgaagagtcctgagagaaatgtaggagagagagagactaaagggtaaactggggtcaaatctgatgaagggcctttattggggatttaggcatatctaagagtagataaccatgcttagtcttgtccattagaaacagtacaacttagctctgtaactgagtagttgtggttatcaggctgttccaaaacagtgagatgcactttgataagctatgatgcctattttttcacatatagg

SEQ ID NO: 395 - DNA, 300 bp, Homo sapiens
aatgcggcccgagagagaaggaacacacttatgggcttgtcctgaaatgaaagggaatgaggaaaactgggtagagggcaaggatgctccagcctggtggctctgctctccaagaggaaggaatagagctttagaagtgtggatggccagagttcagggcagcctggctcccaagcctacctaaaacaaccatcccattcctagacccgtggattgaggactgggcagagatgaatcatccattccagggaagccataggcagaccccagacttcggggagcacctggccttgctcccac

SEQ ID NO: 396 - DNA, 299 bp, Homo sapiens
gcactgtcatgtctctagctgggaaatacacattgaacaactggttggcaacggtaactgttgggccaggcgggcatgcacgcaacatactaccacaaagccagtgaccagctgcaggtgggtgtggagtttgaggccagcacaaggatgcaggacaccagcgtttccttcgggtaccagctggacctgcccaaggccaacctcctcttcaaaggctctgtggatagcaactggatcgtgggtgccaccctggagaagatgctcccacccctgcccctgacactggcccttggggcctt

SEQ ID NO: 397 - DNA, 300 bp, Homo sapiens
ggtaaatcagtttggaatttgttttcatgtactcttaagttactcaattttagtgtcatggagttccaaactgttgttttacagtgatagttattaatcgtatttgtagaaagccaaagcctttattaatacagatggtggagattaaaatgaaacctgttactgattatttagaagttactcccttttatattttaatttaggaatcatttctgtagttgttaattataaattataattacttttgcattttatttacagaaaacctgggagctttccttccaagtgttttctttaatt

SEQ ID NO: 398 - DNA, 300 bp, Homo sapiens
ttgcagtcatgtttctgagaagtcttttgtcctctgagcagtggaaactccctgttgaactgattttgtatacctgtgtaataggatgtcttgtatttctggtttcgttatttgccttttcttacttacagctatgggaaaattccaaaaatcaaatattttacaagatcagtgattactcagtagaagatacatttttaaatcatgtttaatacctaagccaatgaaatgagcattatatagttagagtaagctttttttaatggttagtatttaactatagtatttgactaactttaa

SEQ ID NO: 399 - DNA, 300 bp, Homo sapiens
ctcccctaatccatccccacctgttagaattctatttatctttccagtcttagttcaaataccacttgtttctatgaaactttcttaactttccaacacaaattcacctcttcatttctctattcccttagcagtttgctcataactttattatataatgattgcactccaacttggatcttagctaattacgtacctgcattccacactagactgcaaacttgaggaagatgggtgctgtggctgccctcaaaccgtatgtgcctcccataggacacaagagttggttatgcaggtgtt

SEQ ID NO: 400 - DNA, 264 bp, Homo sapiens
  misc_feature (1)...(264): n = A,T,C or G
atttttatgtgtttattcttattttatagaattcttagttgctggaagccctcaaaacttagtcatattaccattgggtatttattgttccctttcaagtgagggacgagcataatcaaatctgcattgtacatgaccaggatttttttttaaaaaaacagtactgccctggtggatctagtttattattgagtgtatagcagaaaggtaaatagtttgccatgttggtgcatnaaattgnnnngnncncctactnattctatc

SEQ ID NO: 401 - DNA, 300 bp, Homo sapiens
gtaaaggaaagcactaagccattttctctgccctctagaagcttataatgtacagtcctatcacaaagcagaataaaaacatgaaacctataaatgggaatgccataaagtatttttatctctacaggttcattcatgcagagggcatttattgggtgactgcagtactgcaaaaggttgcaaaggaaatggaagatctggtccctgtaggttgggagtttacaatctaattagaaatacaaggcatatatacgtgaaaaaactagaatccccagctgtaagcaaaaggatggagtaggt

SEQ ID NO: 402 - DNA, 300 bp, Homo sapiens
ctcattcgaaaacacccacaacataacataaagattggactctacagcctgggaaaggaatcactgctggagcagctggccctggagtttcagacctgggtggtattgagtcctcggcgcctggagttggtacagctactgggcctggcagatgtgttcacagtggaggagaaggctggccgcatccatgcagtagaccatatggagatctgccattccaacatgctgcgttggaaccagacccaccctacgattgctatccttcccacaagccgaaaaatccacagctcccaccctgat

SEQ ID NO: 403 - DNA, 300 bp, Homo sapiens
gtttagaaactgattctagacatttaagttcccagactaatgtcacagaagctaatgaattgcagaggttaattggaagcctggtcttaacactcccaggttatcttaatgagttcatgaggatggcatatggataatgcacttcaaagggtgttgtaagtattaactaagttaatacaggtcaaatgcatatattagcactcaatgcacggccattgatcaataaatgctagtggttctgatcagtgagaatctaacctctgcttaaatacctttagtcatcagcagcttccactccct

SEQ ID NO: 404 - DNA, 300 bp, Homo sapiens
aaaagtctcccaccttttctcctaaaacttctctcctttctctccataaaaagaaaaggaaaggaacaaaagaaaaacattcagtttttctttttctgaaaaaggtaagtcctttcctgaagtcatcaaatgaaacattatctggaaattagtttctaatgttgtatatgaagaaatacttaaatataagttcctgcagtatttattagatagttgtaactgtaaactcacctccctagtagataagagtttcaggttaaatactggaacatatataggcagtcaaaaatactactttaa

SEQ ID NO: 405 - DNA, 295 bp, Homo sapiens
  misc_feature (1)...(295): n = A,T,C or G
aaaaaataaaagtaaattctaggcaagctaaagagtgaaatgtatcatcacataggaggaagtgggggaaaaaagtgaaatgtaagaaatgaaatgataagaagaacttagtgggtattcgtttgattttggaggcactctaggaaaattctgccagattgtactacatttaaaaaaaattttttttaacttttgtgtgcttcagtttggncatagacnaatgaaaaggcacatcacanactaanangaaaatcagntcctatatatgataacgggttaatatngttntatatgg

SEQ ID NO: 406 - DNA, 165 bp, Homo sapiens
  misc_feature (1)...(165): n = A,T,C or G
atgcgcttattaggtattttatctttcaaaaatatatgtacccaactgtgtttgtttgtttcctgactgtgaacactgaagaggactagatcaaaaatgaccaattgagtagcaattgaacatttacagtgctgngtgcagtgaacttctgtagcacccaaattg

SEQ ID NO: 407 - DNA, 300 bp, Homo sapiens
gctgagatcacataagtacagaatcatgaccttaatggtttgacagtttggaagcaccctggcaacaagccatttcagtggaatggtagaaatggaaaccacgctgggttgagaagtgagtggatgtgaaaatatggggcctctgaatggaggtaacccttgaaaaattccactgtggagaagaaaggagagagagagggctggaatttggaatgaaaggagatatttgggattattttagtaagaaaacagaggtgtcatgacctcagtgtaaccctattagctgcaaaaaattcttca

SEQ ID NO: 408 - DNA, 300 bp, Homo sapiens
gggagcctgtcactgcttgagacagagggcaaggaccacggccttgaactcagcatccacaggacgcccatcttggaggattttgagctcgagggagtgtgccagctcccagaccagtcgcctcccaggaacagcatgcctaaggccgaggaagcctcttcctggggacagtttgggttgagttccaggaagagagtcctgttggccaaggaagaagctgaccgtggagccaaaaggatctgtgacctgagagaagattcagaagttagtaagagtaaagaggggtctccaagttggagt

SEQ ID NO: 409 - DNA, 300 bp, Homo sapiens
cttgtttctctgaggaagctgaattaatggaaagtttctcttaaaacttagaatatattgtttggcaatttctgctgtgggcctaatattgcagaatcaaagttggagctacatcatgtagcacttgcctcaataagattgccttagtgacacaatgcaaaaggttacagacttttcttcaagttaccatttcccacaagggcctgtgatgaaagaagaaaagagaagcaagaaaagaaataagctagatacttccccagcacttggaccttcaaaatttgtacgatacagggagacact

SEQ ID NO: 410 - DNA, 300 bp, Homo sapiens
  misc_feature (1)...(300): n = A,T,C or G
gctatccctcctcctgttccaccctccagaggtagtctctgttacccttttatttataacttttatggtttttttttctgtatttatacaaatcgatgcacaaagagggttctcttctctcataaaagtgattattagtcttcagtgtgcctttttttctcctaacaaatgtaaactgggagcattttcccaagtacatatttataatacttacggtgcctatctagtattctgtgaatatatactgttaattnattccttcccattgncngacttaccttgnttccatgtattgccatt

SEQ ID NO: 411 - DNA, 300 bp, Homo sapiens
gtttagtgttcctccactgctagaaattttggttgttcctgatttttattttcccttttataaatgtctctttggtgaacgttattagacttacagtataatccagttgatacataagcgaatgaagacagtaaccctcaaacagatgtgtgtgtggcatgtacattaactgctatcctttcagcactttgttttgttgaaatggccatttccattatgttcaggaaaactcattttgggaagaataagcaataaatttgtaattaatgaaatctggttcagtttttcagtttgtccagg

SEQ ID NO: 412 - DNA, 300 bp, Homo sapiens
gacagaatgtgcaaattaagtttgaattaatgtaactacagaattagataaaatcttacctgagtactgaggattttgtgaaatgttagaacctggtgtattgggcattatgaacattaacccagggaagcagttaggtttgaaggaaggtatgggcaggagcttgacagatgctggcaacacatattattagatgtttctgtgccatttttatagtcaaagtgtgttcatgggaaaactaaagaatttgggacagttgacaaaattaagtcgtattttagtaaattaattaaaaagttt

SEQ ID NO: 413 - DNA, 290 bp, Homo sapiens
  misc_feature (1)...(290): n = A,T,C or G
gctatccctcctcctgttccaccctccagaggtagtctctgttacccttttatttataacttttatggtttttttttctgtatttatacaaatcgatgcacaaagagggttctcttctctcataaaagtgattattagtcttcagtgtgcctttttttctcctaacaaatgtaaactgggagcatttttccaagtacatatttataatacttacggggcctatctagtattctgcgaacatatactgtnanntnatncntnnggattgacagacttacctngngtccatg

SEQ ID NO: 414 - DNA, 300 bp, Homo sapiens
gtacagcttcatcactggtccagctgtaataccagggtacttctccgttgatgtgaataatgtggtactcattttaaatggaagagaaaaagcaaagatcttttatgccacccagtggttactttatgcacaaaatttagtgcaaattcaaaaactccagcatcttgctgttgttttgctcggaaatgaacattgtgataatgagtggataaacccattcctcaaaagaaatggaggcttcgtggagctgcttttcataatatatgacagcccctggattaatgacgtggatgtttttca

SEQ ID NO: 415 - DNA, 300 bp, Homo sapiens
gttctattcatgtttcatggatgtagtatcttcttttgtctttattaagatactaatggcgttttaaacagtttttgtctcctttcatagtttctgacttctcaatgttgcattattttaaaaaaaatgtttaaaaaggttttggcctccatctttcctagatgctctcctgaaatgtctgacccttgattattgctcatgtttaagggtagggaactaaaattatgaaacttctaagtgtggggattgggttttaccagctatgagcgtcagtgtatagcaatctggctgtactgttgt

SEQ ID NO: 416 - DNA, 300 bp, Homo sapiens
ggaaagggccgtatttgaggtcgtagggattcacagtacagctgcagaacaggactcctcccctggtccggggctgcgactgtgtcacatggacaggctcactggttatgtgctccaccaagttatatgcacaaacgttttgacactacagtcccgcctctggaaataaccttccctatgctcgcacaagattcaaagatgggcatttaccatagcaccatctaatagcaaaaacaacaaaaaacaccccaaacccaaatcctgaatattcgtgaagagaggaatggtgttaggaagtat

SEQ ID NO: 417 - DNA, 297 bp, Homo sapiens
  misc_feature (1)...(297): n = A,T,C or G
agatctagagctttggatctttcgggtatatgtcaatggaggtattattctatagggnctttncattnaaatgacttgnntncntnctncttncncnaaactcgncggctnccancgntnctnccnntcccccgctcncctgcctgcnncccnaccatancctctnncaccnnncacntgnccnacccncgncccantcgcnccncangcccccctccaccntccccacccncccctcctncctcccccnannnanntcncncatcntnnantcnnccancncttccacctctgctc

SEQ ID NO: 418 - DNA, 300 bp, Homo sapiens
aaggcacagaggtggccaccaacctggtgattctctgcaccggcatcaagatcaacagctccgcctaccgcaaagcgtttgagagcagactagccagcagtggtgctctgagagtgaacgagcacctccaggtggagggccacagcaacgtctacgccattggtgactgtgccgacgtgaggacgcccaagatggcctatcttgccggcctccacgccaacatcgccgtggccaacatcgtcaactctgtgaagcagcggcctctccaggcctacaagccgggtgcactgacgttcctcc

SEQ ID NO: 419 - DNA, 300 bp, Homo sapiens
ttttacgattctaaaatcctaacagattttaacagttgcttaaatattatttcttggcatatatagctttttaaggctgtgggtcaaagatagatgtactcatttgagacttagtgatttgttttataagtatgttgaataagttgagccagtttgaattgtgtccttctcttttaaagaaaagatttcccaaatttaaacctggatttagatgttttttgggttaaccctactgaactttccaaaattttcaggcttctgggcctaactcaaactgtaatttcatgaggccggccaagt

SEQ ID NO: 420 - DNA, 300 bp, Homo sapiens
attacacttgaatatttaaaaacaaaacttttaaacttcctataggtttatgatgtttgttttcatttatatggacataatccttcatagctcagtttatatgccattgttgtattagaagggatcaaaatcctatggaacaaagtagtcttggcaagttggcagtttgtgtcctctcagctgtttaacttatgtaatggatgttttgcacctgaaaacactataaaaatccagtggttgtttaaaaagtccatttgtcactaattccattcaggttctccaaccttcttcttgaatatc

SEQ ID NO: 421 - DNA, 300 bp, Homo sapiens
agatagtctctgaatttagaactgggacgaaagtgtacataataggctattataaaatttttagaattggatttctaaacttggggtcagtgaatctagcaggcttaagcagtgttctcaggtttttctggcacagacaaggaatataagaggaggagagaaaaggagagacagtagtgggagggaatagaatgagagaagatagaaaatatggaattaatagagaaaggatacatgaagtattacaagattttcttggaaaaattggcatttcagtgatggatcaaagatgtctaatga

SEQ ID NO: 422 - DNA, 300 bp, Homo sapiens
  misc_feature (1)...(300): n = A,T,C or G
gcccagtaccctcccacctttgaccggtaccaagggaagaacacctacctggagaagattgacggcttccgagcctattacaagcagtggctgacagtgatgcccgcagaggaaaccccgcacccctggcagaagttccggaccaagccccagggggaccaggacaccggcaaggaggctgatgacggatgtgcccttgggggcaaggtgatgggagcacagcttggaacaatgtgctcggccccagtgctttgtggaancccnaggncanttacnttggggtnacctctggcctggggg

SEQ ID NO: 423 - DNA, 300 bp, Homo sapiens
gctaattcagcatcttcagtagcttctaaaaaataagcatcatcaatgccattatcccagacagcatcagcagatgcacctgttgacagcctgctaggtgatggtttatgaggattctgggtttcattgctcctagtttcatctgcttcatctgttgtaaactcttcttcctttatttcagtggtgaagggatagagagtgggataggaaaatatttactcaggatatgtgatttaaccttatactctatgttgaagtaaggtattaagtgacagatactaaagtgaatatgcaggagga

SEQ ID NO: 424 - DNA, 300 bp, Homo sapiens
cttttccctcccaaagttctgggattacagatgtgagccactgtgcctggccttattcagatcttgaaaattccttttgccgtataaggcaacatattcacaggttccaggattaggccatggacaattttggggaggtaattattctgcccactacaccttgggaggcattcatttgctcacctttactttctttcctctccctgtctgtactgataccatggatagtctatcttctcttcacttccttctccaggaatttcatttattctcatacatttgatatttaatgaggatgac

SEQ ID NO: 425 - DNA, 259 bp, Homo sapiens
  misc_feature (1)...(259): n = A,T,C or G
ggggagccagagaagagctgtgagcagggaagggatagggtcaactctagtgacatcacactgatggacaggagataagaggccagggaggaggctgggcggagagtccagagcggaaagtgagtgcccagctctcacttccttatgtctctctctgcttcttacggccgctgtccctgaatgtttcttccctgtctgggtctgggctgtgggcttcctgcagagggctggggggttttcaccccttttttntnccnta

SEQ ID NO: 426 - DNA, 300 bp, Homo sapiens
  misc_feature (1)...(300): n = A,T,C or G
gacagaattcacattgggatccagtcttttcctcttatgaatgggtctaccgccaggtgacgctcaattgcacgaagcttacccttattcatatgagganncnaccnaanncacattngcattnatgtncctntnngatnaagagcgcntgcnnanccttccctntntgcccngcagacccncactnntncccacttccatgcccnnnntnccatnangctnacntttncgctncntctgacggtcncntttgccctctgtcccnanacanncagcnggntncaccancaggaagctttt

SEQ ID NO: 427 - DNA, 300 bp, Homo sapiens
tgtttttgtttgggaggtatttctgaacttaaaaaggaaaattgcaaaccattatagggactagtttgcctttggaggaaaaggaaaattgcaaacccttataaagaccaatttgcctttggaggagaaagccaatttatcatccaaaatcctcagaattctcaaatacaaaaagttctgaaaactgaaagtttcttcttaagtttggtggcaaaagttatttatagtcttgacttatcccatttgatgtgaatctgcttacatttcattgcacaaaatgtttctgtgattgtgaaatac

SEQ ID NO: 428 - DNA, 300 bp, Homo sapiens
gcacacacacgcacacattccgaagttgacagactaacatacacacagacatgatgacaaccaaaagctgggactccacacactgaatgcaggactttaggcggggggcagagagagaaggtgctggggcacaagaggcaagggtatgaagtccctccaaataggagtggagtgccaactgccctgcctcgctccaaacacctgactcctgggccatggcaagagtccagtccattaagtgcagcgtgcaatactagcgcttggagtctcctgtcctcatcaatgaagcggtgtggacgg

SEQ ID NO: 429 - DNA, 300 bp, Homo sapiens
agatcactcaaaatttgcatgtgaagaatataagcagagcatcggtagcactagttcagcttctgttaatcattttgatgatttatatcaacctattgggagttcaggtattgcttcatctcttcagagtcttccaccaggaataaaggtggacagtctaactctcttgaaatgcggagagaacacatctccagttctggatgcagtgctaaagagtaaaaaaagttcagagtttttaaagcatgcagggaaagaaacaatagtagaagtaggtagtgaccttcctgattcaggaaaggg

SEQ ID NO: 430 - DNA, 300 bp, Homo sapiens
ccacgatgaggaggaggatgagtatgaagcagaggatgatgaagaggaagaagatgaaggcagaaaggattcagatactgagtcatcagatttgtttactaatttgaatttaggaaggacctatgctagtggctatgctcactatgaggaacaagagaactaggggagctgctctggtggccgtgtgtgagaggagcaggagtgagtgtgtgtgcttgatgaattgtgtgtggttgttcaaaagtaccttagccacttagccttgtgcagaagactagttacacttaatgggccaagcaa

SEQ ID NO: 431 - DNA, 300 bp, Homo sapiens
cttgaagccacctttttttccctccaatcagaccactgctgtaaaccacactgacactattgtagtatgcttttttcctatacccataacacagtgggagattaaaaataattttgtagggtaggaagagaagtggatagagagccaggagatctaggtttgggtgctgctggtcctgcagttaagcaggcatatgtctttgggcaagtcatttcacttgtttagattaattttctcacttatgaagtgagggatttggactgcttagcgaggtacttttcatctctaaaatttatgaat

SEQ ID NO: 432 - DNA, 300 bp, Homo sapiens
gatagcaaaacctgatttttcaaccatgacctgcatgagagaagcatcctaggaagtcttagatcatacttttgagtttttaattttaatttatatagtgtttttttatgtcttaatatttttgtgaactggtgtaaattgttaatgcatataagcttgtgtatttttgtaaatagttttgtgatttatttcttgccccatatgtaaatatttagagtctcatttcttgcaaacttatttgaagctgagttgtgggtttgggttttgtttgtttctttggttgcagggtggggtgggggg

SEQ ID NO: 433 - DNA, 300 bp, Homo sapiens
gcactttccatcaccaggcgcgggagtttgctgtgaacttgcggaaccgggtgtctgccatccatgaagtgcccccgcccagatccttcaccttcctcaatgatgcctgccagggactggagcaggctcggaaggtgctggcctacgcctgcgtgtacagcttctacagccaggacgcagagtacatggatgtggtggagcagcagacagagaacctggagctgcacaccaatgccctgcagatcctcctggaggaaaccctgctgcggtgcagagacctggcctcctccctgcgcctcc

SEQ ID NO: 434 - DNA, 300 bp, Homo sapiens
cattcatataatgatcctatgaggcagaaggaaattaatcagatgttaagtcatgtgtccaagggcattcagcttagaaatggaactgggatttgaacctagagtaaccataaaatccttccttttctacaccaccatggtacctcctagatgaagctgaattttgcctctaagctactagtcctcacaatttagtttacaagtcatctggggcataaaaaccagacacctagaccttatgtagagattgctacagcacaggaacaggtgtcttagcaagcatgacgtacaactaagatg

SEQ ID NO: 435 - DNA, 300 bp, Homo sapiens
tgtttttgtttgggaggtatttctgaacttaaaaaggaaaattgcaaaccattatagggactagtttgcctttggaggaaaaggaaaattgcaaacccttataaagaccaatttgcctttggaggagaaagccaatttatcatccaaaatcctcagaattctcaaatacaaaaagttctgaaaactgaaagtttcttcttaagtttggtggcagaagttatttatagtcttgacttatcccatttgatgtgaatctgcttacatttcattgcacaaaatgtttctgtgattgtgaaatac

SEQ ID NO: 436 - DNA, 300 bp, Homo sapiens
gtgtccactctgtaggcagtttgctaacagtgttcttccatgttatcctggaagcaatgtggaaaataacccttggcaacgtcctagcaacaaaagcatacaagatctcataaaggaagtggaggagctgcagggacgaccgggagctttcccagtaagcatcagttcagaaacaaatttaagtaaagaaatggaatctgtaatgaaagatataaaaaataccactcagaagaaatatagagactatagcaagaccccgggctcaccagacaatgattttctctttatgtactctgttgc

SEQ ID NO: 437 - DNA, 277 bp, Homo sapiens
  misc_feature (1)...(277): n = A,T,C or G
aaaatatttgttaatcaaatgaacatgattgctaaaagggccaaagaagattacaatacaaaaagtataataaaagaaaattataaattctaaaagcattcaaggaagctgtctttgaatttgaaatgcattgtctatagaatatccactcagtggaatataatatataccttgtgatatgtggatatagatctcactaatttctaatgatgctttanaatttngntactnccgatggtntggnatgngtcttngnaacnnntnnntnattggtgtt

SEQ ID NO: 438 - DNA, 300 bp, Homo sapiens
gaagaactgtatgtcaaataattcaaaaggggcaaaactgaatgtagttatgtgggaaagccttcagaaataatttaaatggcactgtttatcagagtatgtatgccgaggaaaactaagaatttagtgagcttataaaaccatggtagccaggcgtggtacgtagctcacacctgtaatcctcccaaagtgctgggattataggcgagagccaccacgctcagtgagtatgacatttttaaaagaacagtataaagcataaaatatcccatgtggggcaaactcccagattattttcct

SEQ ID NO: 439 - DNA, 300 bp, Homo sapiens
ttttttttgaattattgagaatatttctttggacccacaactataaaatgtgaaaaaaaataaaaagtatgccaaaagggccacgtgtttctacaacacacgaaagtaaagaataatactgcatgtctaatatgcaaataaaatgtctctgccaaaatatcacaacttaaaatgccattatgaaacaaaccacagaaagaccttatttgtgttacataccaggaacataccaaaatttgaatgtctgatccacacagtgattcacataagatgataaagaaacaaatggatattttgtga

SEQ ID NO: 440 - DNA, 300 bp, Homo sapiens
aaaatatttaacttataataatcaaggactcaaaagatgaaaaatagaaattacaccatcccagtatttcaggtataacacagaattagtaagatactggcaaaaatattacaatgtatatatttgtatagagaaggaaaatgaagagactgcatgtctatacctaccaaacgaaactacctgtgttctttgcatcattattcaactggcagttacacatatttcatcctaaagtcacgtaaacctgtgtggatatgttgaatcaatagggatatgaattacataaaaagaattttgtgt

SEQ ID NO: 441 - DNA, 256 bp, Homo sapiens
  misc_feature (1)...(256): n = A,T,C or G
tgactgcaatcctaattctcacatgttttggggaaaaaattttaattttgaaaaaatttaggaaagttcctaccaaatatacatgtataaagtttattaaaagtcataatgacccaggaatagctaatgacacagaagtagatcaaaatagaacacantagagaacttnanantaaaacaggcgtnnnaattntgtnccnnnctnnttgcnnngncnntntcaccnctngcccngcncnncncncgtgncnntcnc

SEQ ID NO: 442 - DNA, 187 bp, Homo sapiens
gagctctctctggaaagctcgcactggaatggagaacacaagcaggaaatgtgaaaagtaacggttgaaagccttacttatgatgacacatagggaggcaggtgcatatcttacaattctagacacttggataccttgggaaaccatattgaaagttaccttgatttctttctttcttttttttttt

SEQ ID NO: 443 - DNA, 300 bp, Homo sapiens
gttggcaccttcagttcagcacagcctgagcagtgagaaggtctgaaaggagagtatatagttaagatccttgagaaagggctgcctgaggaactgacctcttaaagatctcaggatctttaagacaacaagttaggttcctactggagttacctgccagaatggcctcttaattaactcaggtaatgaagagctaactgtgttataatcatcttgcttttgcctgaatttggagaaagtattataattaagttcccagtatcagaaatgtccttacataagattaaaatatcttgatga

SEQ ID NO: 444 - DNA, 300 bp, Homo sapiens
tctggatagaaatgcagaggaggctgctctacagctggacagtagtgagctctgggccgccatgagactgcctgctccatgttgtatgtggggcagatgtgggagaaggatggtgggaagaatggcttccaaactgtcgattgatcagataaacaagggaggatgccaggggataatgccaagaagaggtgggtaaagaaaggaaaggaatccacaaaagggaggaggggagtgcaggtgtgcatgtgttctgaaaagtgctcatgcacatacagtttgcttattatttaaaaacttact

SEQ ID NO: 445 - DNA, 300 bp, Homo sapiens
gctagcttgtattgttgtggcttccttcgttctctgctggctgccattctttacagaaagggaacaaaccctgcaggttctaagaagactcttcccggttgatcgtggattatttgaggataaagtagccaatatttggtgcagcttcaatgtctttctgaagattaaggatattttgccacgtcacatccaattaataatgagcttttgttttacgtttttgagcctgcttcctgcatgcataaaattaatacttcagccctcttccaaaggattcaaatttacactggttagctgtgc

SEQ ID NO: 446 - DNA, 300 bp, Homo sapiens
gtcacctttaaggaagaaagtaaatttgaattgtcaggaagcaaagttatggagcagcaatctaatctacagccagaggccaaagagaaggaatgtggagactctctggagaaagacagggaaagatggagaaaacatctgaagggccccttaaccaggaaatgtgttggagcttcacaggaatgtaagaaagaggcagacgagcagttaattaaagaaacaaagacatgtcaggaaaattcagatgtgtttcagcaagaacaaggcatctctgacttacttggaaaaagtggaattact

SEQ ID NO: 447 - DNA, 300 bp, Homo sapiens
ttttagtccagtggcttgtaattaagtcatttttagtctttaattatgttggttgcttttagaattctcttttagagttggtctacatccttttaaaacatgggcaatccaaatttataacagtaaattaagatacataaaaaaaaacactggctaaatttaaaaggaaacacttctagaatatactgtattttgacacaagaccagactgtgctatgtgtatgtggtgtttcaagtaatttaagaaaactgttggaattttctgtatttccagtttcacaagaaacaacctcaaggagg

SEQ ID NO: 448 - DNA, 285 bp, Homo sapiens
  misc_feature (1)...(285): n = A,T,C or G
gccaggcaacaggactaaactacctccaaagcaagcagtcttttcagttttgactgagtgatgtgaggaacttcttttcttttntttnnnttcntttttntnnnngntttttttgaanctgnttnngtttnnnttntananggtncatgtttagctgnnttttttttttttttttaatntggnaanttatttgngtnntttgtnagngantttttnttnnnnttttatangttntnaggnngnancccnntttnntcnnttttttttnnaaaattngngtttttt

SEQ ID NO: 449 - DNA, 300 bp, Homo sapiens
gaaaaaaccaatttaatagaaaagataggctttgcttcaggaagctggttgagaagaagaaggaaaaagtcgattctactgactgacgtttccccctgctgttaagaatcccaaccacacactttcacacactattccaggttctggctactgaatgatcccacagctgaggtctattgtcatcgctccacttctatttttagcagcactaaaaacattcccaaaaaaaatgttttttagctttttaactgtagattcaccactaagaaattggcattggaacagtccacagagcttatt

SEQ ID NO: 450 - DNA, 300 bp, Homo sapiens
cagctgccctggaggtgtttaccatgtcccccattttccagaaggcgaagctgggacatggattaggtcagctgtccaaggtcatggagcaggatccaaaggaggcctggagagtgccatctgtctggccccttctttgtgctgcctctagaggatactggggaagcctcctcttgtctgactctgccaggatacccttggccatcaagtgctcagctaagccacagtgccactctgggtcaggccgacctgggcccagctgtgcaggatgaggtacaggaggcagctgccacagctgct

SEQ ID NO: 451 - DNA, 300 bp, Homo sapiens
ggtaattaataagcagacaaatcagaaacaatatagaagatctgaaaaatagagttgaccagctctaatgggtccctgtatccaatagttagagatgggcattgtttttaggcacatgtgaaataatggcccccccgttctggcccagcagaaattatatacttggcaacaagtctcatcacattttaaataaactgtcaaaaagataacattctcatgtttccgcaatttaattttaaaatgaaattaaatttttttgaaggtaaaatacattttggaaatctaaactgtttaactctt

SEQ ID NO: 452 - DNA, 300 bp, Homo sapiens
ccattgttagcatcgtacacgattgtgatttttatgtcaaaagaagccaaaacttgcaatactatttttagcagacaaaaaaaagaactaagtataaaatgtataaatatttttgacttgaacatttggatggcactgggtgcaagtagagcatccatccttcggatggaatgtttggaaaaaagagacttttaaaaaggagacggttgttttaaagagtctgtttaggggttaaagtactgtaactcacgactgttaaaaaataaattttcctgtgctgtaaaggaaggtttcacagta

SEQ ID NO: 453 - DNA, 286 bp, Homo sapiens
  misc_feature (1)...(286): n = A,T,C or G
atcgtatttattacttgttgtataggggtagaaaagaggactgtcaatacaacaagtaataaatacgatatatatttcatatatagaacattagaagggtaaagctctacagaaaaaaaaaaanggngggcaaggccggccncaggggctnacncctgnaatcccagcnntttggnaggctgaggcagggaaatnacctgnggncaggagttcaanaccagcctggccaacanggggaaaccntgtntntactaaaactncaaaaattacctggncatgggggagg

SEQ ID NO: 454 - DNA, 300 bp, Homo sapiens
cagatttccaaattgttaacactttgctgcatctgatgttttccacctctattgtatgtgttttttttctctaagccaataggagtaagctacaggatatgacaccccttgacctcttaatatttcagtgtatttcctagaagcgaatgcattatcctatatagtcacagtgcctgtaaccacaccaggaagttagtattgccaccaggcctcacactgtgtgcagtgatgtttcacaggctcacccactgtatatagtgatatttctagtccccttcagtcaggaacggtcccttgcct

SEQ ID NO: 455 - DNA, 300 bp, Homo sapiens
attgcctcccagcttgggagcatccaaagtagaaccatgactgggtcatgaaatgggttaatttggtttctttcattacagggcaaagttctccctgtggactgagaaataaacatattataaaagttacatatgctcatagaatagaaatcaaagagtaaaaagtattgagtgtaaaaaacaagtgtcttttttccccccagtctaactccccagaagtaaccttttttattttttatgttattttttcttaccttcaaggaaggagaaaagtaaccatttttgagttgatgcgtatcc

SEQ ID NO: 456 - DNA, 300 bp, Homo sapiens
gagggaggatcccctgggttgtgcatatggcgggaaggggtattccaggagtggaggatgtcagcagggtgggaatgggatcagtgaggggaggaggagcagaggagtcagaaggatctaagggtagggctgaaggtgggaaaacaacctgtagggctgtttaggacacggaaagggccttgactttgctgccaacgaagatgtgaaggctccaggcaagggtaacaatctaacttacattttatgagggtcctgtggcagctgtggtgagaacagactttaggggtgctgaggtggatc

SEQ ID NO: 457 - DNA, 300 bp, Homo sapiens
gcccgttctccctttcttggttaaacggatgaagaaataaaaatgccattttcatttgtaaacttgtatttttgtatttatatttaggagtataaaatgtacttatatttaggactacaaaaatgtacctgggaaggtgacgggacctctatactcaggttaagtctcgactgcacactgacaggagtatgtagaccattccatttccctgaagactcagccttgttagtatcaggactggtcggcagatgtgcaggaaaaggtggcaagaaagtgcaagttctagaagccgatgatatt

SEQ ID NO: 458 - DNA, 300 bp, Homo sapiens
actggcccaattaatattcatgcctgggagtattagataggtgctccaaaaacaatatagatcctatttccaaatgaggaggagtggatgcagagttgaaaggtgaaaaaaaaaaatgttctttatagtgctccagtttcctttcttagaaaagtctaactactgattgattgattgatttacttatttagggttggaggtgcagatttcattgacaatcagaaagggcaagtttgatttgtcttttcatcctaaaagtagcaacaagtgtttgcaaaaggctggctctttgttcagtgc

SEQ ID NO: 459 - DNA, 300 bp, Homo sapiens
gagatgtgtcatcctggtgaatgtccctttaactgcaaccagaaggtaaaacttaaatgtccttgtaaaagaataaaaaaggaattgcagtgcaacaaagtacgtgaaaatcaggtttcaatagaatgtgacacaacgtgcaaggaaatgaagcggaaagcatctgagataaaagaagcagaagccaaagctgctcttgaagaagaaaaacgaagacaacaggctgaactagaagcttttgaaaacagactgaagggtcgtcggaagaagaacaggaaaagagatgaagtggcagttgag

SEQ ID NO: 460 - DNA, 300 bp, Homo sapiens
ttttatataagcagtactctttctcagtttctcttgaacattcaactcattagtgagtggttttccccagtcatttccatttttctttatttggctctgatagttttctgtttttgtttttcagagataatcctttactatactaaattctacgtgattatattttccacctctatttgcctatatttatctgctgtcttttccttttccatatatgggcttattttttttttccctcttcttccttttctacctttggtatttaaaaagttacttaggactgagtgcactggcttacgt

SEQ ID NO: 461 - DNA, 300 bp, Homo sapiens
gagatgtgtcatcctggtgaatgtccctttaactgcaaccagaaggtaaaacttagatgtccttgtaaaagaataaaaaaggaattgcagtgcaacaaagtacgtgaaaatcaggtttcaatatgaatgtgacacaacgtgcaaggaaatgaagcggaaagcatctgagataaaagaagcagaagccaaagctgctcttgaagaagaaaaacgaagacaacaggctgaactagaagcttttgaaaacagactgaagggtcgtcggaagaagaacaggaaaagagatgaagtggcagttga

SEQ ID NO: 462 - DNA, 300 bp, Homo sapiens
  misc_feature (1)...(300): n = A,T,C or G
ccgtggcccgtgggggatacagaggcagaggaggtcttggtttccgtggtggcaaagggcgtggtggcggcagaggtggtaccttcactgcccctcgaggatttcgcggtggattcagaggaggtcgtgggggccgggagtttgcggattttgaatataggaaaaccacagcttttggaccctaaaaggtctggattgatcgtactgctttctgaaagaaagacgtcaaagctgctgcatagtctacaaacnngtctctgaaaatangtgaatttctagctcttcatggtcctgaacatt

SEQ ID NO: 463 - DNA, 300 bp, Homo sapiens
  misc_feature (1)...(300): n = A,T,C or G
attggagtgacatttctcacgtgtgaatttttcacataactaaaaaacaaacctaaaaaaaagttagagttaaaaaaatagtaataccttccttttaggccagttgcggtggcttacgcctgcaatcccagcactttgggaggccggcacnggtggataatttgatgtcaggaggcttaccagcctnngcagctggngaanccctatcanacctgannannnngnnantntntgctcatgnggtcttcaanttntttttntcttntgcttngntaccantngncactgctccatgttaaa

SEQ ID NO: 464 - DNA, 300 bp, Homo sapiens
tgtacttaactgttgtgtgatgtgtgcttttgttaggcatcactgtgcccaagtatttcatgttcattgtaaagaggaaaaatacagatttctctataatgtcaccacttatttctaattgccacttttcatcttgtggaaatgccatgttttgattcagtcttctgaatttgaacattattcaggttatttccaattgctgggaatatccttactgctaaaataaattcttagcattggaattgctaggtcaaagattatgcatgctttttaagggcttttgaaatgtattgccagtct

SEQ ID NO: 465 - DNA, 300 bp, Homo sapiens
aatatccccaaataacatgtcttacatgtttggtaagacttactgtaccctgtcctagaagatagaagatgccctgcccttagaagacaaagagactgtagagctatgccttctaaatcttaagccactcttcagataatggatcccttcatggtcagcccaaacatctcaagaacttttaatttgtaccgtttgtctttttttccatttatttaataccacaaattcactttattattatgaagccaatatctacatcttctcacaaagattctcttaagaaatgcagaactggccggg

SEQ ID NO: 466 - DNA, 300 bp, Homo sapiens
aggacatgaaaaggagtgaaagttaagaaaccttagctgtagtgtttggaattaacacttgggaagtcatgattgacaaatagagaaatataaatttgttttatatcagttatatatacatatttataactgatataaaacaaattagattttgacattagaaacacatatacacatactgtaatatgtactttcttcattctctttaacctatattctggttttaagtttcctggagcccgtggagtaatgggacaggaaggctcagagggtctctttactgatagttaagatacaaaa

SEQ ID NO: 467 - DNA, 279 bp, Homo sapiens
cgggttggagcctggcgtagtcatggccgccttccgcgacatagaggaggtgagccaggggctgctcagcctgctgggcgccaaccgcgcggaggcgcagcagcgacggctgctggggcgccacgagcaggtggtggagcggctgctggaaacgcaagacggtgccgagaagcagctgcgagagatcctcaccatggagaaggaagtggcccagagccttctcaatgcgaaggagcaggtgcaccagggaggcgtggagctgcagcagctggaagctgg

SEQ ID NO: 468 - DNA, 300 bp, Homo sapiens
aaacaagcgacactctagtggtgatgggaatagtaaattaaaaagtgagtagatggatttggacaacataaagcaacaaaatttgagatggttgaatgagggccggaggccatgatgaaaagggcactttggaaagggttggggtggaagggaaatatttccgggtgggtgtgagctgttgggcttccaggtcagctcttggccatgcagccatgcctgcaggatgatcagaagtcacggcacctcatgggaaggttaagactggagcaaagcttttccaaggtgagcatattcagcgtt

SEQ ID NO: 469 - DNA, 300 bp, Homo sapiens
  misc_feature (1)...(300): n = A,T,C or G
cttgatatcaatggcctgccatatggtctgtgtgccggctgcgtgaatctcagtaagagcgccagcccaggcattaacgtccctcccggcacgaatagaccaggcttgggccagaatgagaatctgagtgccattgaggggaaaggcaaggtggggggactgaagacacgctgctctagctgcaacgttaagtttgagtctgaaagtgaactccagaaccacattcaaaccatccacganagctngtgccatacngcaacngcanncngttnaaaanccccaagtatnccantgcccaaa

SEQ ID NO: 470 - DNA, 292 bp, Homo sapiens
gtgaaatgatttgctgcactgcaagggaggtgagtgagaccaaggaactacacccaccaagatcccttccaagggtctaagttgcttctctaatcagaaacctctcaaacctttgcgactgtgcacataggtcccatgatggctttggcaacatttacctgggaccagggtgaacttcgtaccatgtattgcatatgagaaaagaaaagaatgtttgtcaaacaaaccactatgttttattttattttattttagtgttgctggtaggtgtgtagtgagttctcagtgtgtg

SEQ ID NO: 471 - DNA, 256 bp, Homo sapiens
  misc_feature (1)...(256): n = A,T,C or G
gctctttacttggtgaacacatattgtaagaatgtgaactgatgattggaaacattacttttgacaagttcccatacttgaaatactacaaaaacatcacctaacaagcagaacaaccatgaatgggtagacattgattaaacatttaaaaagaaacaaaaaagggagatggcaaaaaaaaaaattgtttacatctgttttaattgattgggtgattcattaatcattnnttgcttataannnntacntnntccta

SEQ ID NO: 472 - DNA, 300 bp, Homo sapiens
cacaggcccttttgtgatgcgttccacgtgtaggagatgtggtggccgcggctccatcatcatatcgccctgtgtggtctgcaggggagcaggacaagccaagcagaaaaagcgagtgatgatccctgtgcctgcaggagtcgaggatggccagaccgtgaggatgcctgtgggaaaaagggaaattttcattacgttcagggtgcagaaaagccctgtgttccggagggacggcgcagacatccactccgacctctttatttctatagcccaaggctctctgactgactccgtcccaga

SEQ ID NO: 473 - DNA, 300 bp, Homo sapiens
gcagttttccagctctaagcaccggcaaaagaggaaagctttggcactgctaatcctcctttctacacaacctccctccctcctgcccgagttcctcctcgcacttgctctgtttgtcctctcacctttctctgtcaaaatctgcacttggatatgagcctaggatcagtcatttggaccttaatttcagtgtgtgtgcttcctttgcctcaaattgtggcaagaaaaatagtcgttcctcattaaagcagtatcagctatccttgagcacaagtgggaggttgggtattttttggagac

SEQ ID NO: 474 - DNA, 300 bp, Homo sapiens
gcaccacagaataagagtttgccgtgtaaagacaatatccccattcgtcatgctcttattttcccgtgggatatttgcatacaaatgcatgtctgttaccaaaatattgtgtaacacagacagaaaccacctgtttttgtctttccttgtttcccttaatatttcatgaattgtctagcaaaaatggtaggatgcttctgtagttcacaaatgttacatttcagagactttagaggaaaaattattttaaataactgtcaactgtttcattgctttttaaatttttcacgtgcataaccc

SEQ ID NO: 475 - DNA, 300 bp, Homo sapiens
cttaatgtttttcaattgctcaacgaactgtcagccctgtcagatatcatatatctggtaaaattaccccttaggaatgagggggaaataaatacatactagatgaaggaaaactaagagagtttgttgctagcagacctaccctaaaagaaggctaaagaaagttcctggctgggtgcagtggctcacgactgtaatcccaacactttgggagactgaggcctgccaagctgaggccaggtggacagcttgaagcctggagttcaagataaccctgggcaataaagggaggcctcattc

SEQ ID NO: 476 - DNA, 300 bp, Homo sapiens
ccaagatattcccaaatctccaaatttaaaaatagctctttcgcacacgatttctcccacagaatgtagtaatgtagatatgaaacattcaggtgaacttgttagaactaatggttctataaataaaaactgacatcattcataaagttatttaaataaattttgtcactaaaataaatttatatgttacatcattgctaataatgattttaactgtgagttttctttttgtaaaaaagaattgagccaagccccagggtttttctaacaagctgacgggatacttggctggggttctca

SEQ ID NO: 477 - DNA, 299 bp, Homo sapiens
  misc_feature (1)...(299): n = A,T,C or G
atccaattatttctagaaatcccattgatttcagggaactgaatttgatagccaggaggcattccactggcttcttaaaggacattattggttttcattttgttttgttttgatttcaattgcaactcaaacaatgaatcttccaaagatggttaccctcactctacaaaagtgctaagttaatattctttaaaataaatacaagcatttcttggactagataccatcaactttaattttatttttctcacataaatggtaacccaaaacttaatgaaaatttccttntgncacacagc

SEQ ID NO: 478 - DNA, 281 bp, Homo sapiens
  misc_feature (1)...(281): n = A,T,C or G
ttttatgaaagccctgggactatagatttagctgattaaatttatagaaaaagtcctgtcatataaactggcaaagtctgttcttaatttaattagccaaatcagacttaacttccgtcagaacatgtcttggttttaattcagataaacacacnaacatacttctctggcacagccttcanaancatcngcttttgntctgttntcgtncnnnnncgtgnnctntcnttcnnntncgctgctcctcgnntngccgtnttgngncgnnaggtngtcgctcg

SEQ ID NO: 479 - DNA, 300 bp, Homo sapiens
acttgtcatggagctggcactgtggcgctctcccgtcccgcggtggttgctgctgctgccgctgctgctgggcctgaacgcaggagctgtcattgactggcccacagaggagggcagggaagtatgggattatgtgacggtccgcatggatgcctacatgttctggatggctctattatgccaccaactcctgcaggaacttctcacaactgcccctggtcatgtggcttaagggcggtacaggcggttctagcactggatttggaaactttgatgaaattgacccccttgacagagatc

SEQ ID NO: 480 - DNA, 300 bp, Homo sapiens
ttttagatcttctgaagtatatcagtggctttaatgacaaatcaggcccattttctcctttcctatcattatgctgtatgtatagatagaatatgtattttagatgttttattgtttagttattattttagtcttatccttctaaagttcagcaaagctttaggtaaatggcgtggatttttgaaatcctgcattcagtcgctagctgacatttagaatacaggaatagtagtttcctggaaaacagtgacacttatgttaaattcttgtggtttttacaaagtgaggtgtcaacacaga

SEQ ID NO: 481 - DNA, 300 bp, Homo sapiens
gataaacttcacttatcaatattacttatatttggctgcatgcctctgacacttcatctggcctcatgtgttttccattttttctttctgaacagactagcccatgccccctgcccacctcatctcacctccacctcttcccttctccattcccctttggttcaccctttggcagaaggtactggtggctcagcctgcatgccgctgtctctcctctcgtgctggcatgtcatggtggcactgttgtgatctcttcctcttcctttttactaacagacgcagaccaaactggagcatgcc

SEQ ID NO: 482 - DNA, 300 bp, Homo sapiens
aagaagaaaaattacaagaaaacatctggtttttgcatgtttgatgtgtttgtgtgtgtgtgcgtttacagttttaactgatattaagtgaagatagattaatgtcacccaggttttacaaaatcaaagaaatagaaataattttaaagacttttggtacttgaattactttgttgttttctggtcatttagtacatttatggaacctcagaaggtttgagttgaacagaggcaagttacagcagttttttgggtgggagaattcataagtcagcatgtgaatcttttgatctcatatat

SEQ ID NO: 483 - DNA, 287 bp, Homo sapiens
caaacttctttgtcttttgaatagtgtgcctttaatagaacacatatagcatagttctagggattagagtcttctgacttcattactatttttacagtaatttatatcttggtttcttcaattagaaaaaaaaatcgggcctgattttttatttcatttactagctcagctgttctcacacctacctgctgaattagaagggacaagtataatccatcttcttttcttctttccctccttctgtaataatgtttttctattttgcaggggtaatttttttttttttt

SEQ ID NO: 484 - DNA, 275 bp, Homo sapiens
  misc_feature (1)...(275): n = A,T,C or G
gcggaggggaaatggctgccgaaaacaagccggaagatgatcatgggaacagcaatagtagtcatgtaaaaatctttttaccgaaaaagctgcttgaatgtctgccgaaatgttcaagtttaccaaaagagaggcaccgctggaacactaatganagattatgatgcatttgtcttnttnttttttntatnntnttnntntnnnntttttttntttntatntantnnttnntnttntannntttttnnnnnttttntttnttngggacttctttt

SEQ ID NO: 485 - DNA, 286 bp, Homo sapiens
  misc_feature (1)...(286): n = A,T,C or G
ggtaagtgcttagaacaatatctaacacatagtggttgcccagtaaatgtgagctgtgttgattttgagattataactacaataataactttttcaaattgatacatatttagccgatataatctaattttttaagatggaattattctanttntnnnatttntttnttnnnnttntttttttntnnntntnttnnnnnttttnntntttttnttttnntntttttnnttttnttntttttttnntttntttttttttnntnnnnnttnttttnttntnttttttt

SEQ ID NO: 486 - DNA, 300 bp, Homo sapiens
gctgagagaccccttgctgatgcagctctgatggcaccagtgactgtccatcatgcattccttttattctctctcctttagtatcgattttaaagggcattaagcactatggttccagagtttcttggggaaaacttgcagattcttattaattggttctgcaatacttaaataaattattttacaattataagttttcagattataacatttgcattaatttttactgattttccaagatacttcttacatttactatttacgtacctttatgtacattctctgtaaaaatagacctct

SEQ ID NO: 487 - DNA, 300 bp, Homo sapiens
gtggagtgttggctttcattttttcttgggcaagatggaaaattctcttcctgttactccatcttggccagaaatctaaattctcatataaaccgattttgcttgttcagttgttatttttatttgcaactaaaagcaatgtcatgcatgatgacttgaagaaatgtctgaaacttttgaaaattccttatttggcaagaaaatctacttatttatttaaatagctttcgaacatacccttccctcactcataattgcggggtaggagcacaccacagtttattagtaaaagttatttta

SEQ ID NO: 488 - DNA, 300 bp, Homo sapiens
agacatttacagccatttatccagccatcataattttattgagtaactattttgtgtgaggcactgtactggatgctttggcaacagagataagcaaggcaacccctgtgaataaggcactcctggtctacacacagtgggagaaacatagaaattcatctcttctgagcggagcctgtgggaacccagaggatggacacccagcgtggactgaggaatcatgggccataacaggaggcatctggagagatctcttgggtaaagaatagtgagggctggaaggatattccaggcagtggg

SEQ ID NO: 489 - DNA, 264 bp, Homo sapiens
  misc_feature (1)...(264): n = A,T,C or G
caggaataatgctgacatacatacatatatatatatatatgaagagagagagagagtcacacacagacagacagacacacggagtctcgctgtgtctccntgnctggagtgnatnnncttntaggncntnngtntttccttncngggttnctntctnagaganagagagagtcacacacagacagacngacacacggagtctcnctgtgnngcccaggntngngtcttgangnnnntttttannnntnttgnntntntgnttct

SEQ ID NO: 490 - DNA, 300 bp, Homo sapiens
gaaaagtgagtctgtccagagatacttatagacggtagttgattagagacgagaaacgaaggaggtgaagccggggtttctggcatggggaaccagatgggtggtggtgccattcactgaaatagggagcactcaatgagcagattttctgagagaggtcaggaagcaggatagtgatgtgatggtgtgtgtggagacctgcaagtctgtcggtgcactagccttcacttcagtggggagaggcttctaccactttgggaaccatcagtttgggattgatagttaacccattggagtaga

SEQ ID NO: 491 - DNA, 300 bp, Homo sapiens
tagtgatggggaactgactacctgaaaacagctcactcaattgtttaacacttccagttgttggaaagttctaaagcatatcaacagctaaccattattaagcacatattgtgtgctgggtattgtgttaagtgcttgtatgtgttttcccttaaatactctctgtaatcccttgaggccaggttagtatctccattttttagagcaggaaacagagatgtacagtttcttgttcaggctcactcaggtggtggtggaacaggaatggaccccatgcagttggcctgcagcctgtgctcc

SEQ ID NO: 492 - DNA, 288 bp, Homo sapiens
  misc_feature (1)...(288): n = A,T,C or G
gatcaatatacagttgtcctcagctggttccaggcccccccccaccccttaccaaaatctgctcatactgaagtcccgaagttagccctgcaaagaccctacagaacctgcacttaggaaaaggcagccctctgaataccagggattcgagtccctgaccatggatatgtgggtccacgtggttcaaacaagtttttttttgggacggtgtctcactgttgcccaggctcnnacnnnctaggtcnccncttncnncntcnncncttcatccnntccttccgtcccgtc

SEQ ID NO: 493 - DNA, 300 bp, Homo sapiens
gtgcctcctgcctctccaatcctgatcccccattcccagccaaggagaggttttcagcccttggtcaccctgatgacctgcagctttccaggccctaggctgagaagtttaagtccagtgtctcattaatcctcataataatctagggaggccgggcacggtggctcacaccttgtaatcccagcactttgggaggctgaggcaggtggatcacttgagttagaagtttgagaccagcctggccaacatggtgaagccccgtctttactaaaaatacaaaaattagctgggcgtggtggc

SEQ ID NO: 494 - DNA, 262 bp, Homo sapiens
  misc_feature (1)...(262): n = A,T,C or G
gattgatgtaggttttaaaaaaggcatttgtatgttgttagcttacatatggggctaggtaatttcattgcttaaaaagatgcgcctaggctccctcttggtggctggatttctttttcttcgcccgtggtggccatggttcttaatagggccaccggaatcatggtttctttctttttttttttttnaaaaggnannnnccccttggacccnngnnngaangccagggccccaaatntggnntaanngaaccntnnncnnc

SEQ ID NO: 495 - DNA, 300 bp, Homo sapiens
ttaaagagccatgacaacaaaatgcagcccttgattctagtctggattctggacttgaagggaaacatttttcttatcttttgctataagggacattagtgggacacttggcaaaatttaaattaactgtagattagataatactattgtattgttaattttctggcttttattctactttgattatattataaaagtccttgttgttaggaaatagacactaattattttgggttaaaggaatatcatgtgaaattcactttcaaacagttccaaaaaacacagtgatatatatgtata

SEQ ID NO: 496 - DNA, 264 bp, Homo sapiens
  misc_feature (1)...(264): n = A,T,C or G
ggacagtggttcctgaaggcctgtggcctaggagaaggagacactgaggtgtttcctacccaacatgtggtccgtgctctccaaactatctttgagctgaacgtccaggcctttgcaggaggggccatgggggctgtgaatgggatgcanccctatggngtccctgactnattnanngtnnntnctnantaantcttgngttttcttgtttttnnttntttttnttntcnttttnnttanttnnntntttttnttttttnnnnt

SEQ ID NO: 497 - DNA, 300 bp, Homo sapiens
atcatacccagcctgtgttgttttttaacaatatataataaaagccaacatttattcagcactgaagtattttatacacattagctcacttaatttttacaacaaacctgtgtgggaagtactgatataattaatcgatattttcagataagaaaatagcagctgaaaaagtacaaatactttcctcaaagacagacagggcttaaatcaggcctttctgatgtagaccatgctcttcactaccacagagttccatgctactttctctccctctccctcctctcctgtccctgctacaca

SEQ ID NO: 498 - DNA, 300 bp, Homo sapiens
gcaacgaaataattttaaagtggatctgggttggtagtgcttatgggagttaggcaaggaaaaatgcagattctctttagaatatcttcacctaggtcccaaaggattctcatagatagatttccaacaaatatgaggttataataaaaaatacaaatcacatatagaagtatggcaccatgaatgagaaaggaaaaaactgtcagaacaagaccctcaagactttactggaattaacaagcaatatgtaaagtaaatagaaataagctattcataataagaataatgtataagagacta

SEQ ID NO: 499 - DNA, 300 bp, Homo sapiens
  misc_feature (1)...(300): n = A,T,C or G
caggggtgagccaccacaccaggccaagcattttctttcaaatacaaggaatatttttctgatttaaaaaaaaaaaacgaactttttttctgataatcaaagggaaagttgcaaagatgaaaataaaagtcatctgtaatctcaggtaataccaggtaattaacattttgctggatttcttaccantgaaaatgaangcntatttttaaggtggntgcngncntnnttncnngttnntnnntnggnttngttancnnnnagnatgtnnttcntnttanncttgttntnnntgtagtctct

SEQ ID NO: 500 - DNA, 300 bp, Homo sapiens
tggctgtggatgttaacaacatgttgcatctgtacgccagtatgctgtacgaacgccggatactcatcatttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaa

SEQ ID NO: 501 - DNA, 300 bp, Homo sapiens
aaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcc

SEQ ID NO: 502 - DNA, 300 bp, Homo sapiens
gccagctcgagtagacgaagttcctgatggagctgtaaagccacccacaaacaaactacccattttcttttttggaactcatgagactgcttttttaggaccaaaggatatatttccttactcagaaaataaggaaaagtatggcaaaccaaataaaagaaaaggttttaatgaaggtttatgggagatagataacaatccaaaagtgaaattttcaagtcaacaggcagcaactaaacaatcaaatgcatcatctgatgttgaagttgaagaaaaggaaactagtgtttcaaaggaaga

SEQ ID NO: 503 - DNA, 293 bp, Homo sapiens
  misc_feature (1)...(293): n = A,T,C or G
tcaggctgggagggacttcagttagcatggtgggggagaaccagtaccacatacccagtaggtaataaggtgtccagcagaggatgaaggtcagcaagataagcagggccagtctcagggcccggagacgaacacggtgacaattgtcaaaggagcgggggagggcaaattcaccagcaggggctaggaatttagaatatatactgtacttcacacactcactttctgatctgagtatagggtgaattgatggagggtcattcctagtgngannganntngcctcctacaatg

SEQ ID NO: 504 - DNA, 300 bp, Homo sapiens
ggaaaaggagatcaatggctcaaaggtcacctgtcggggactactggagtattttaaggcatatattaaaatttatcaaggagaagatctgcctcaccccaagtccatgcttcaggccactgctgaagccaacaacttagcagctgcagcctctgccaaggacatttattataacaacatggaagaggtttgtgggggagagaaaccttatttgtctccagacattctagaggagaagcactgtgaattcaaacaacttgctctggaccattttaagaagaccaagaagatgggtgggaa

SEQ ID NO: 505 - DNA, 284 bp, Homo sapiens
gaccgactgaagctgctggtgctgtacagtggagaggatgatgagctgctacagcgggcagctgccgggggcttggccatgcttacctccatgcggcccacgctctgcagccgcattccccaagtgaccacacactggctggagatcctgcaggccctgcttctgagctccaaccaggagctgcagcaccagggtgctgtggtggtgctgaacatggtggaggcctcgagggagattgccagcaccctgatggagagtgagatgatggagatcttgcagtgcta

SEQ ID NO: 506 - DNA, 300 bp, Homo sapiens
aaagtgaatatcgagttggtaacgccaagaataccagaattctggaaatccatgaagcagcagcataagtggtttgcctctttctccagcagcaacatagtgaaatcttaaccctgaatccttgtattcttggcgttaccaactgagagaatttaaaagtgaatatcgagttgtagcactggatttgagaggttatggagaaacagatgctcccattcatcgacagaattataaattggattgtctaattacagatataaaggatattttagattctttagggtatagcaaatgtgttct

SEQ ID NO: 507 - DNA, 298 bp, Homo sapiens
  misc_feature (1)...(298): n = A,T,C or G
gctgctcaaggattgcagggatgaggcaagtggaacagcctcggaacctccgaaaatgggcacgctccaggtcccagtttctatggcaaccataccggcaaattgggctccgcaatggtttctcctggaaaaaccgtgattttggttaccgcngacgtctntancnntnggnnngnctacnnnnttntaaannntttatatgngaatatgtattgcatatntntngncancacttantnctttacattntctatgatgcnnngacctttgttangttttttgnctnntgacccttttc

SEQ ID NO: 508 - DNA, 299 bp, Homo sapiens
gcggctcttttccctcgtgactcggttgctcctggcgccgcgacggggcctcacggtccgcagtcccgacgaacccctgccggtggtgcgcattccagaagagctcccgagacatacttctctgcacagacatagcctctcggggcctggacagcactggtgtggagctggttgtcaattatgatttccccccaacgctgcaagattacatccacagagcagggagagtgggccgtgtggggagcgaggtgccaggcaccgtcatcagttttgtgacccatcctgggatgtgagcctgg

SEQ ID NO: 509 - DNA, 300 bp, Homo sapiens
  misc_feature (1)...(300): n = A,T,C or G
ggatcttcttcaatcagcaataacaggtggctctatagaatggagggtagaagggatgtgggtgacttactcagtttttagttaaagaggaccctcttctgttagcatggtgaagtgcagtttctttaataaattgtgcatggtgggggtgggattanntttnctgtngtttacttcagncttgcttnnacncctantnaatccntnattntannntnntctctctttctncctncctctctttnttcnntgntntnncnntnccctntnncctgnccnttnnnaanattctntcctctt

SEQ ID NO: 510 - DNA, 300 bp, Homo sapiens
gtggagggatgcactatttcacaaggtccaagatttgttttcagaagatgaaaatgaaaataaaatagagtttaggaagaaaggaggatttgaagggggaggattccttggaagaaagaaagttccctatctggcatcatcaccaagtacttccagagtgctgggattacaggcatgagccaccacacccgacacttaaagggcatttcttatttatccttgttttagtcacaccatagtggaatgagtaatcagttttagaagctgcaaatttaccattctctcaaagatgctagtgta

SEQ ID NO: 511 - DNA, 300 bp, Homo sapiens
aaacaccaagaatggcacctgtttggataaataaggctatgtttttgaaagtaacctttccacaagtcaataacagaagctatggtgaaatgtaaaaattcacaattctactttgtttcactgagtgcccaatcaacgattcatacagttgagatgaatgtgacaaaactctttatagataaatatatatgcctaagtttatctatatatatatgtctttgtgtgtatatacatacacagatatatgcaaagacataaataatcttccttacaaaacatcaatagatcattttcacaggg

SEQ ID NO: 512 - DNA, 300 bp, Homo sapiens
ccagcctgcgtttcaaccaagaccaaagctgcttttgctgcgccatggagacaggtgtgcgcatctacaacgtggagcccttgatggagaaggggcatctggtgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaacccca

SEQ ID NO: 513 - DNA, 300 bp, Homo sapiens
gaagctttcatgtcctgcattgtggaatcgggtgtgtcaccctctcaacacattgatatgttcaccaaccaggatgcttcaccatgcttcggtatctaaagtttttattggggtttcattatatatgtataattgattgaatcactggccaagtgattgaactaaatctccaccctaccccttactctgggtgtcaggctgactcaaagcaccagctatgtaatcacatggttgttctcgctggtaactggcctccatcttgggtcatctcatcttccagcccaaattcaggtgtgatcc

SEQ ID NO: 514 - DNA, 300 bp, Homo sapiens
  misc_feature (1)...(300): n = A,T,C or G
gagaacatctttgagtaagaagatgcagtgtttgaacctgaggaaaagttaaagcgtagaaaatattgtcttgccgaaggattttgcagtcctctgtcagtaacttccattgattacgcagacatattcaggtaaaccctaatcattaagaaaaaaattatcaatgtagaaagtaattcccttttttctctctgagatatacctcaatcacacacttccccacccccacttgaaacagacctcttcacttgtgtttttttttcctgaggtggagtcttcccctgtntgcccaggctggag

SEQ ID NO: 515 - DNA, 300 bp, Homo sapiens
tagaaatgagatgactttatgtctaagatttgcattaaaatactataatcatttgaagaaagaataaagtaaatatgccaaattttgtattataattcaatctgtatgacagttatgtgagtttttttttgttttgttttatgcttgtgtgaagatttttgtagttaagctttttttaaaaaaaagtcaactgagttacttacgtgatgaaattagaacacatacttcttacaagcacattctctcctatccccctctccatttcagttggcaccataatgccatttttgcctaaccata

SEQ ID NO: 516 - DNA, 300 bp, Homo sapiens
agcaaatgtgggaactgccaaaccaaactgcacgacatcgacggcgtacctcacctcatcctcatcgcctcccgagacatcgcggctggggaggagctcctgtatgactatggggaccgcagcaaggcttccattgaagcccacccgtggctgaagcattaaccggtgggccccgtgccctccccgccccactttcccttcttcaaaggacaaagtgccctcaaagggaattgaattttttttttacacacttaatcttagcggattacttcagatgtttttaaaaagtatattaagatg

SEQ ID NO: 517 - DNA, 300 bp, Homo sapiens
  misc_feature (1)...(300): n = A,T,C or G
caaatgtgggaactgccaaaccaaactgcacgacatcgacggcgtacctcacctcatcctcatcgcctcccgagacatcgcggctggggaggagctcctgtatgactatggggaccgcagcaaggcttccattgaagcccacccgtggctgaagcattaaccggtgggccccgtgccctccccgccccactttcccttcttcaaaggacaaagtgccctcaaagggaattgaattttttttttacacacttaatcttagcggattacttcanatgtttttaaaaagtatattaagatgcc

SEQ ID NO: 518 - DNA, 300 bp, Homo sapiens
ggcatgagccaccatgcctggcccaaaacttcttaaaaaggatgatgatggtggtggtgataatattgttatcatcattatctaacacatagtgcttactttctgccagttgttgttctcagagctttacatcattaattcatttaagctttgctattgacctcctcacggatcttaaagactttgaccttacaacctcatgaaataaatcctactgatgcgattgtacagatgaggaaactgagctaaaagaggcacaacagcttaaacccaggttacacagctaatacgtgatggaac

SEQ ID NO: 519 - DNA, 300 bp, Homo sapiens
cttgaatcccttgaccttactgatgagaaaaaggtcctcgagtgggctcaggagaagcgtaagctgagcgtgttgcatattcacggagtctacaccaaccctagtggcattgtccttcatccggctggatatcagaacgtgctcaggaacactgaagtcatgagagaaattcagaaactctacgaaaacaagtcatttcttttcctgggctgtggctggactgtggatgacaccactttccaggcccttttcttggaggctgtcaagcataaatctgacctagaacatttcatgctggtt

SEQ ID NO: 520 - DNA, 300 bp, Homo sapiens
gttcagtggtcaatacaatagtccaccaagagactgggaatgattagaagtgaaattggtccctccttaccaaggaggggcagatgatctccattgcacagggcgattagattctggagctgaggtggggactgcaggaggccacctagtctggtaggtttcaacccaagctgtgtacattagaattcccttgggagcgtgcaggaaatacagatgcccatgccacattccagaccaactgaagctgaatctccagagtagggcctgtatggtcatataagctccacaggtgatctgcag

SEQ ID NO: 521 - DNA, 300 bp, Homo sapiens
aattgatttgctacatgcttaaaatgatagaggttgctcagcatttttggagtacaagggggtcagagagacatgtgatgaaaattacagggcgagtacagagatttagaagggaacgggttttaatgcgagtatctatgacagagtcttgctctgttgcccatgctggagtgtagcggtgctcgctgcagcctcacattcaaaggctcaagcaagccttccttggcctttgaagtagctgggaccacaggctcatgccaccatccctgggtcatttttaaattttttgtagagagggtc

SEQ ID NO: 522 - DNA, 258 bp, Homo sapiens
  misc_feature (1)...(258): n = A,T,C or G
cagagcttagacatccaaaactaatcaatgctgaggtggctaaatacctagccttttacatgtaaacctgtctgcaaaattagcttttttaaaaaaaaaaaaaattgggggggttatncatacattgacaacncntngattnnngaaaattnttnntttnngcnangcgattnccgtannagaatggaactgtagcnntnaagngctacnngaaanaatttnantanncnnanantnntntnnntntncnnnanantt

SEQ ID NO: 523 - DNA, 300 bp, Homo sapiens
gttaactgcactctgttcaaggagggtttgaattggagacacagagcagtcatcgttgatggcaaatttgaaatctagccaggcacacatttccagttccttcatcagggcccagtcctactcgcagaattgttctccacagtttgacttggccctctgggctttcagttttttcttctgagtctttttccttttccattaaaaaattagcagagttttgcagtgattggctgtcttggcctgcattctacttgttgtaggcccagtttatgttctttctacttcagttcaaggtgttgt

SEQ ID NO: 524 - DNA, 291 bp, Homo sapiens
  misc_feature (1)...(291): n = A,T,C or G
gccagatcccagattcaacagcagaaacgcttgttgaatggcttcagagtcaaatgacaaatggacacctaccagggaacggagatgtgtatcaagaaaggctggcacgtttagaaaatgataaagaatcccttgttcttcaggtaagtgtnttnacntacnnnttttntnctnnntgnnatatnttctttgatttctttttttnntttntctnttgctttatntgnttttattnttttttnctngagttttnttntttntctnanntctgnnttanntntnntttctctt

SEQ ID NO: 525 - DNA, 300 bp, Homo sapiens
taaagacaaaaagatcttcatgattgtcattccactccaggtcctggcaaatgtagcctacatcatcatagagtccaccgaggagggcacgactgaatatggcttgtggaaggactctctatttctggtcgacctgttgtgttgtggtgccatcctcttcccagtggtgtggtcaatcagacatttacaagaagcatcagcaacagatggaaaagctgctattaacttagcaaagctgaaacttttcagacattattacgtcttgattgtgtgttacatatacttcactaggatcattgc

SEQ ID NO: 526 - DNA, 285 bp, Homo sapiens
  misc_feature (1)...(285): n = A,T,C or G
tcagaatgaaacagaacaagtccatttttattttctttcactgcattgcatatggtactcaagttgtgttgtgtatagctaataggatgccattcacattttatacatctttttttttttttngnaanggnnnnccnnnttngcccccnggncggnnggccngggcccnatnnnggnnnnnnggaatnccccccnnccgggttnangccnttnnttngccnnaaccccccnnngannngggaccannggnccccnncnntaccccnggnnaantttttggttttt

SEQ ID NO: 527 - DNA, 300 bp, Homo sapiens
gtccatgctaatttctagattgatgttttagccataaaaatgcagtatttaataatattttattttccaaattatggaaagcttcagaaatagaaatattcaatataattagtactctctaatcttttttctaggttgaaaaatctttgttttgctttaggttagattatgttgaaacacatctgtgtttcagatgtgttcagagctgaggtctcagctgaggctccactgaagcaggattcacttccaaaataacagagttgttgccaatattcagttcgtagcaaactactggaacaa

SEQ ID NO: 528 - DNA, 300 bp, Homo sapiens
aataaataaatgggacctggttaaatagcttctctacagcaaaagaaataattgtcaaaataaacagacaacccacagaacgggagaagataagacttgtaaactgtgcatgtgacaaagaactagtattcagaagctacagggaactcaaatcagcaagaaaaataaataatcccaccaaaaagtgggcaaatgacatgaatagacatttctcaaaagaagatatgcaaatggtcgagaaacatatgaaaaaatgttcaacatccctaatcattagagaaatgcaaattaaaaccacag

SEQ ID NO: 529 - DNA, 300 bp, Homo sapiens
gggtgagataccacgcatgaaacccacgtggactgcaactcaaagtgtggtccttggcccagcagcatttgtcagaaaggcagaatctcacagggccaggactagggtggcacaggtgaggcatcccgggcacagcatttaaggaggccctcactgtcagggtcgtacagggcacctcctcggctcaccctaatcccagctctgaggtccacccagacctttctgagtcagagtctgccttttaacaagactctcagcgatatgtatgcccagaggagtgtaagaagatctggccttaga

SEQ ID NO: 530 - DNA, 291 bp, Homo sapiens
gaggaacaagaagcaccactacagggagctcccagttgaggtgcgacaggcactcggccaagtccctgatggcttcgtccagtacttcacaaaccgcttcccacggctgctcctccacacgcaccgagccatgaggagctgcgcctctgagagcctcttcctgccctactacccgccagactcagaggccaggaggccatgccctggggccacagggaggtgaggtgggctggatgccacacagatggtctccgtgctggctcactgaatagctgagcctgtggctggcct

SEQ ID NO: 531 - DNA, 278 bp, Homo sapiens
  misc_feature (1)...(278): n = A,T,C or G
cttaaagatgcataacaaagtcaggggattcattctatatgatatccaatgagtatggcattggcataaggctagacaaacagggcaggacagagggagtgaatgaacagacacacatatatttggacacttgaatgtggataaaagaggcaatgtaggaaggaagggaaaagatagtcttttcaatagaaggaactggatcanagagatattcaatggaananaagaacgaaattttacctnttnntnannacntangnaagtnaattattacttac

SEQ ID NO: 532 - DNA, 258 bp, Homo sapiens
  misc_feature (1)...(258): n = A,T,C or G
caaacttaaaataaaatccccactatgcacattttatttctccaacatactcggattctaccctagcatcacacacacacacacacacacagtattttgacctagggattgactatgtaacttaatttggagacaattgacatataaaaatattgagatttccaactcatgaacataatatatctctctacttatgtcgtgtttgatttcttttagcaatgtttgcagtgtacaggttttacnccttttggnaggnnt

SEQ ID NO: 533 - DNA, 288 bp, Homo sapiens
tggaaaagaaaataaaattggcagctcactcttctgtcatttgatcttctgtcatttgcttttctgagttttggccctcctgtacaatctatctggtcgggtttacttttctccatcttcaagcagggtgtgtcttcaagcatgcatgtctgtgttttgattcggaattgatagttataatagaagcatgagctgctgggaaattatacctcctgatttgtgtggttttatttgttcatcttgcaggtttgagtagtttttggtggatgtgttgggagatatgaacgc

SEQ ID NO: 534 - DNA, 223 bp, Homo sapiens
aagacacatagtggatctgtatggcgtgtgacatgggcccatcctgaatttgggcaggttttggcttcctgttcttttgaccgaacagctgctgtatgggaagaaatagtaggagaatcaaatgataaactgcgaggacagagccactgggttaaaaggacaactctggtggatagcagaacatctgttactgatgtgaagtttgctcccaagcacatgggtc

SEQ ID NO: 535 - DNA, 265 bp, Homo sapiens
  misc_feature (1)...(265): n = A,T,C or G
gccacatctgccagagcctggagtctgcgaaggccgggacccggttccccggcccacagtgggggtgtgcaaacccgnnagaactggttaagatntntttnnttcgctgttntgntttttnnnccgagcttatctnanntntatanttggcnatntttnnnnctcttgtntnanatttanntatctttttcntcttcnnntnttttntnctcnantntttatnttttttntcttnatnntttctaantgcctntntcantttntt

SEQ ID NO: 536 - DNA, 300 bp, Homo sapiens
  misc_feature (1)...(300): n = A,T,C or G
cttttttgtatttttacgctctgctgtccatgacatatttctaacacctttatgattattgttcctgcttgtaaaagggctgatatttacatgagtgcaaggcaggaagaaaaggtagctgtgccagccacttctggcaagcagttctcccaccttagcctcccaagtagctgagaccataggcatgagatttctcaaaattcctcccagcaggctttcacttagtttcattgttgagaactgtgacaggtccatctctagctgcaaaggaggctgagaaagngaacacagcagcctcct

SEQ ID NO: 537 - DNA, 259 bp, Homo sapiens
  misc_feature (1)...(259): n = A,T,C or G
catttatatatatactatatatttcatatatgtatttcaggaatttatagaccacacattcatatatagatacagatatatatatgngngtgtgngnatatacncatanntantnaagcgtatatncngtagtatacatnatncacncatananacgtatatatgnaaacgnatatanacncgtnanataattatatgttatatntacngtatntacgtatacnncatatgcacntgntatncgtntntntgnntntnt

SEQ ID NO: 538 - DNA, 300 bp, Homo sapiens
gcctgctgagcgtgatgacttcatcctggggattctcaactgcgtcttcattgtgtactacctgttggagatgctgctcaaggtctttgccctgggcctgcgagggtacctgtcctaccccagcaacgtgtttgacgggctcctcaccgttgtcctgctggttttggagatctcaactctggctgtgtaccgattgccacacccaggctggaggccggagatggtgggcctgctgtcgctgtgggacatgacccgcatgctgaacatgctcatcgtgttccgcttcctgcgtatcatccc

SEQ ID NO: 539 - DNA, 300 bp, Homo sapiens
gtggcaagttggttatatggaaagtctctgttcactcacttgggtgaataacagtaaatacctttctattgttttcactttacattaggccatgagtatttgtgcctgtggctgcagtttgtgttagtttcctaccccaggtatctcctgcagcatgcagcttcagtcctaccagaccctcaaaacttaaaagctaacactattactagggaggattttgcaggaaaatggagaaagggttacacacaaaaaaggttaaactactctatgcatgtttctgcaatgtgttatctcaagaat

SEQ ID NO: 540 - DNA, 300 bp, Homo sapiens
ggttcacactccatttcccagtttctgttgacccccaccttccagtgttggacaggatggaggggggacacttgcttaggggctctcctgggccccacaccagtgcccaccccaaatctggtcgtctcctccccccatgcacagcacaagctaagggctgccctctgcccacacgctgcgttcactgccaatgctgtactcacctccatcaccctccaactttggggcccatgtcttccttgggccaaggtctcatgggggctagggccaagttgggggcccaggaggcggggagggaag

SEQ ID NO: 541 - DNA, 300 bp, Homo sapiens
gtccattcttataaagggaacttctagcaaacctgcccagccctttccctggagggaaacattatctgtattatcctaaagagcaaacaaatctgctcttggttccaaatagagacactttatctttcaagacaatgcctatgcaaatatcttagaaaagatagtctaggagaaacaagctgccacaagaactgcaaaaatgcaaacagcctataaagaattgtctcccaacatattgatcttttatattattctctttatgcgttgtcataaaaagttgagagactgcaatcctgcacc

SEQ ID NO: 542 - DNA, 297 bp, Homo sapiens
  misc_feature (1)...(297): n = A,T,C or G
gtgagcctagggacccatttctcctcctttgacagggacatcagtggagccttctcagacccacaggggtccttggggaattttgacatggttatttaaggaaccttgcctagaagtcccaacttgcagttccccatcgacgggaaggcttggactccaagatgattataaaggaatatcggattcctctgccaatgaccgtggaggagtaccgcatcgccatctgtacatgatacagaagaagagccgtaacgagacatatggcgaaggcagnggngtggagatcctgnataaccg

SEQ ID NO: 543 - DNA, 271 bp, Homo sapiens
  misc_feature (1)...(271): n = A,T,C or G
aggacgaccgctacttgcacttcctggaaggcacccgggactatgagtggctggaagcactgcttatgaatcagacggtgatgtcaaaaaaccttttctggctcaggcgcagaccccaagaagctgctcgggaagccctgtgcatggacaggtacatgttgctgcacccagactttctccgatacntnaanancagnnttttgaggcntattancctgganggtanncatcatcnnganatannttccnatttctgangtcctnactgcgg

SEQ ID NO: 544 - DNA, 300 bp, Homo sapiens
atggaatttacttttcttctagactttcttttgcaatggaacgttgctttgtgtgtgatttggtggaataacaaccaatacacaatgagcagtctaatgtgtagtcatttggtgctctgtgttcaagtgtgaaatctctatcagtgcccaatagtaagccagggtctgcttttcatatagaaaatggttgctgacagaagaagatgtggccgtactccagggtggttctctatggaggcttgtgagagtctctatacagcatccatgactgccaccggcacttccaataccattagttat

SEQ ID NO: 545 - DNA, 300 bp, Homo sapiens
ctccatcaaggcatttctcttcattggatattgcagtctgcacaattgagagagccaatggtctgatcaatcgcctcatagaggaaaataagatggatctgttaggaatggtggttgtggatgaattacatatgctgggagactctcaccgagggtatctgctggaacttttgctgaccaagatttgctatattactcggaaatcagcatcttgtcaggcagatctagccagttctctgtctaatgctgtgcaaatcgttgggatgagtgctacccttcctaatttggagcttgtggctt

SEQ ID NO: 546 - DNA, 300 bp, Homo sapiens
cagaaatcagcatgcatgaattaatcgaaatacaatgcatattaaacaatgcaattactatagtctaaatcaccaaactgataacccatacaaaagtagctcttacaactttttttgagaatatttcccctaaaaaattccagtgatcatcccaacctacaaaactagattattttactagtatcatcttctctttacccctcttctccccaccaacactccctccaacacacacacacttctccttaagagaaacggcttcctcaagaaattatctgatggttcagtagcagttggagt

SEQ ID NO: 547 - DNA, 300 bp, Homo sapiens
aagaaggtgggggcctgccacggccccaggaccccactgctgggcaccgaccagtgtgccctgggcccaagcttctggtgcaggagccaggaggccgccaagctgtgcaacgctgtgcaacactgccagaagcatgtatggaaagagatgcacctccacgctggggaacacgcgtgaccgtggctgccagagacccagagcctgctagcgaggcccatgaggtgggtgctttccccatccccatttcacaaatgaaaaactgaagctctgaggagggaggctgggaaggagcagagctga

SEQ ID NO: 548 - DNA, 293 bp, Homo sapiens
cctatgattcattcattcaataagcttttactgcataaactttacatccagcactgtagttaagtacccaaaattgaatagaaataatggcttttgaaaattgcccaaagcaggctgggattacaggcgtgaaccactgcacccggcccagtactgcatcttaacagccaagccattttattctactttataactgatagacttgataccatccatctctttaggttacagaggataatttgaagagaaatgttactgtagaatatatagttctgtactttttttttttaaga

SEQ ID NO: 549 - DNA, 266 bp, Homo sapiens
cgcgacgcacattgatggagcgtatgtccaggcgccggtgcaccgcaaggagcaaaacagacacagttcttggtcctagggctcacgtcccggggcgaagaggatcctccataaacgatcagccatagcagctgtgattggacaagagactgatttcagtgactttctcctgataagagaccaccgaccagctgaccatgccgaccagctgacccgttaatagagagagatgatgcacctgcatgcctttgtgtcctgaaaatgac

SEQ ID NO: 550 - DNA, 300 bp, Homo sapiens
gcttggggagagtgatggtagaaggacctcccaggagggccctggagacagtgtgaaattcgagggaggtgaagatgcttctgtggctgtggagtggtccggggatggcagtgggaccctgcagaggagtggctctcttggcaagatccgggatgtgctccgcagaagcagtgaactcttggtgaggaagctccaggggactgagcctcggccctccagcagcaacatgaagcgagcagcctccttgaactatctgaaccaacctagtgcagcacccctccaggtctcccggggcctcag

SEQ ID NO: 551 - DNA, 271 bp, Homo sapiens
  misc_feature (1)...(271): n = A,T,C or G
ggaaagtggagaggtctctgctgcgaagagaggcactttcagggactttccttcagctgtctcttcctctgggaatgagctactcaaggctgacccctcctcctgttgcttgaaataatgatgatatataggttggattnngnagtntgtnacctccngctcaatctcctnctncntctctacctnnnntcttctccntnctncctnncttcgntnnnncttnncnctcccncntnttactctnacanntccntntncncaccctcactct

SEQ ID NO: 552 - DNA, 300 bp, Homo sapiens
ccggaggctggtgctgagccagtggctgggcatcctagccaccatcgcggggctggtggtcgtgggcctggctgacctcctgagcaagcacgacagtcagcacaagctcagcgaagtgatcacaggggacctgttgatcatcatggcccagatcatcgttgccatccagatggtgctagaggagaagttcgtctacaaacacaatgtgcacccactgcgggcagttggcactgagggcctctttggctttgtgatcctctccctgctgctggtgcccatgtactacatccccgccggctc

SEQ ID NO: 553 - DNA, 224 bp, Homo sapiens
cggatatcctctccctcatcaaacttttctccaccaactttagcatctggttgccaccctccaaaatggccccagtgatcccatctcctaataagtacatgtctgtgtggtcctctcccacactgcataggaatggcttacgtaaccaataggtagttgaggatgtgatgcagtctgacttttgaggctaagttgtaaagaaagacactgtgtcttcctccttg

SEQ ID NO: 554 - DNA, 268 bp, Homo sapiens
  misc_feature (1)...(268): n = A,T,C or G
cttgagtctaggagttcaagaccagccttggcaacgtggctaaaccccattgctacaaaaatatatatatacaaaaaattagctgggagcggttggcacatgcctgtagtcccaactactcaggaagccgaggtgagagaatcnnnnggnnncnnnnntntactntnangttaaanaannggntttanntnnnaaattanctggaagcggntgncanatgcctggngncccaantactctggaggccnnngnggnaaaattnctggaa

SEQ ID NO: 555 - DNA, 300 bp, Homo sapiens
caaatccaatagcaagctctgttttctaatatagtaaatgtctttatagtaatagtgagtaatcattaattctaaagatagaattattattacaataaacaaactttagtcacatattggcagtttttctatttcaaacacagcaccagagatcagagtctacttgaaacttacatttgtgttatttaacaatttttctgtatctttttcattggtgttttgttttgtttatcttttgtttttgtttctttggtttggtttgtttttgttttgttttttgagatacgatctctgtcacac

SEQ ID NO: 556 - DNA, 300 bp, Homo sapiens
gctcagtgctggcatgttgacctggtgttgtcagtgagtctgtggatccagggtcagtgctggtatgtttagctgacattggcagtgagtccatggatccaggctcagtgctggtatgttgacctggtgttgtcagtgagtctgtggatccaggctcagtgctggtatgttgacctagcattggcactgagtctgtggattcaggctcagtgctggtatgttgacctgacattagcagtgagtctgtggatccaggctcagttccacagaggttgtataaacatggtctcaggtgggttc

SEQ ID NO: 557 - DNA, 266 bp, Homo sapiens
  misc_feature (1)...(266): n = A,T,C or G
cgtgttggccacgttggtcttgaactcttgacctcaggcctcccaaggtgctgggattacaggcgtgagccaccgagtctggccttggcagttatttttcattactttttgttttttttggacnaggtctggntntgtannccaggctggnatgnagntnntgnnatnacagatnnntgnnnggntcaacnnggnaagannngatgnggnttcncggggnnntngnnannaantngtnantnnnnnnaangantacatgaagntag

SEQ ID NO: 558 - DNA, 300 bp, Homo sapiens
  misc_feature (1)...(300): n = A,T,C or G
aaaaatacaaaaattagccaggcatggtggcacgtgcctgtaatcccagctactcgggaggctgaggcaggagaatcgcttgaacctgggaggtggaggttgcagtgggctgagatcacgccattgcactccagcctgggcgacagagtgagactctgtctcaaaaaaaaaaaattatgaaaaaagttatgggattaaagaaagtcaggataaaaattttaaaaagcaggccantgtcagcaaagcctggaaaattggggccggaggctcngcccccatcatgngcctgccaccccttcc

SEQ ID NO: 559 - DNA, 265 bp, Homo sapiens
  misc_feature (1)...(265): n = A,T,C or G
gaggcatccaaaggctcctgagacacatgggtgctattggggttggnggggangtgtgtgaggctgnaantgtnctctnttattaggctatntctancttnccattnactganttcactcaanactgcnnnatnnctatnaannantaanntaaaccntcttaggtcantantantnctnnantgantttcatcantatncctnnacnngttncttngttanncagatancnttaacnttattnnacngagaaantctcttctaa

SEQ ID NO: 560 - DNA, 300 bp, Homo sapiens
agaagaaagcattagcaaccttgatgccatgacaatagaaactatccaaaataaggcacagagaagaaagtggaaaaaaaggcaaaaaggaaaacagagcaacagataatgtgagacaaggtcagatagtctttatgtatgtgtaattggagtccccaggagatgtgagaggaaaaagagttgaaacaatcatagacaaaatatttccacgtttgatgaaaactatattagttgtgtattgctacctaacaagttattccaaaaatttagtggcttaaacaaaacatccattatctccca

SEQ ID NO: 561 - DNA, 300 bp, Homo sapiens
gccacctactgcgtcttggtcatggagaagaagagctggagacagagaaagatttcagcagaatcctcaggatggatttagccgactaaaacgatggattatgattggcgatcatcaccagttacctccagttattaagaacatggcctttcaaaagtactcaaacatggagcagtctctcttcactcgctttgttcgcgttggagttccgactgttgaccttgatgctcaagggagagccagagcaagcttgtgcaacctctacaactggcgatacaagaatctaggaaacttacccca

SEQ ID NO: 562 - DNA, 300 bp, Homo sapiens
  misc_feature (1)...(300): n = A,T,C or G
attaaaaagaaagctttatgtagttatgcatgtcagtttgctatttaaaatgtgtgacagtgtttgncatattaagagtgaatttggcaggaattcccaagatggacattgtgcttttaaactagaacttgtaagacattatgtgaatatcccttgccaattttttttataataagaaaacatctgactaaagtcaaagaatgatttcttatggtttattttgatgaaagttcttttaacatgtcttgaatgtacacataaaggaatccaaagctttccattctaacttaatctttgtga

SEQ ID NO: 563 - DNA, 300 bp, Homo sapiens
gtgacattgtgattgcaaaaagcccaagtgatccaaaatcaaatatttgtaaaagagtaattggtttggaaggagacaaaatcctcaccactagtccatcagatttctttaaaagccatagttatactatagtgataaaaacctgtgctacacatccatttctcagcaacggctcctaggataatcaatcatggcatactgctaatgccttgattgcagctgatatggaggaaatatgtttactcttttgctaaagtgaagttcactgcggaggtgccaatgggtcatgtttggttagaa

SEQ ID NO: 564 - DNA, 300 bp, Homo sapiens
gcccagatgaccttttcaggggtaacaccccagctgcttgagagaacagtgttgctgctggcagagatgcattccagagatgcactccgctctggaactcactctcagccacagggagctgcatgcaccacaggggcaatgcacctttgcaggggtaccttctggccccaacccttgactcaacggggacaactccagaaggtcattccagatccagagatccccatcgaactgaaggatcactgggttgcagacacattgcaggtcagcttcttcctctgcccagtcctgcctcactcc

SEQ ID NO: 565 - DNA, 289 bp, Homo sapiens
  misc_feature (1)...(289): n = A,T,C or G
atcatgactcactgtagccttgacttcttgggctcaggcgatcctcccacctcagcctcctgcatagctgggactacaggcatgtgccaccacacctggctaatttttgtatttttttttttnggnaaaaacncggttttgccgngtngccnaggntggnctnnanctcnngggctaaancaatcnattcacngnagcctntnaaagggctggnatnacnggcntgaccccntgcantnggccgacnttcaattttnatgaataaaacntacntngnaaantaaggggg

SEQ ID NO: 566 - DNA, 300 bp, Homo sapiens
gttttataagtggagtcttcagggaatgattatttgggaattaggctttgaaagagcctcagctgtgttccaccccctccaagaattcaggctgttatttttcaaggctgccacagaggtggggagtggaaaatgagactagtaagttaaaatactacaaagcttgctgttcttacagaaattcagccatttttcttgaataaacacttccatggattgctgcaagccttgattaattgccagaatctgaaatggttgcttttgacagtttttttcccataggtttttgttgcttttatg

SEQ ID NO: 567 - DNA, 299 bp, Homo sapiens
ttttttttttccaattctgttcctttcagcttaggaaccttagtacatgcagtttcttctacctgaaggcttcctcatccctttacctgacaccacactctgactcagggccttcaaactaactaaagcctaatcttctgggcaaagtttgctttttaatttttttttcaacaattgctcaaagagtagttgttttcataattaatccaaaattgtcctaagaaaggccatcatcacagggggcaaagtttaacatcatttcctgaaaagggttatcataccccccaaataaattaggt

SEQ ID NO: 568 - DNA, 300 bp, Homo sapiens
ctaatgtgctataaattcttctgagcttgctgtggctaatttattaatttaaaaagtattttttgtctttcttaggcctccttgaatctagtcactctagagatagaatacacaatcttgtcctgatgtttttacttgcaactcacaatcttgtttggtggtttagttgcaggtttcagagattagaccgtatatatctaaatgctgggatcatgcctaatccacaactaaatatcaaagcacttctctttggcctcttttcaagctgaaggcctgctgacccagggtgataagatcact

SEQ ID NO: 569 - DNA, 293 bp, Homo sapiens
  misc_feature (1)...(293): n = A,T,C or G
gccctggatggaggacaagagtttggtagtcaatggcaacagtaccattcaaaaatagatgatctgatcgacaacagtgtaaaagaaatcatttcactgttagtttcaaagtttgtttcagtgttggaaggcntgtngtctannctgtnaaggttttattnnntnactttnttatctnncntnttttanntcnactnttaaattaatnntttttnttgttatttncatatttttttctnttattttttttcntntttttttttttnttntnttgnntttttnatanttttaat

SEQ ID NO: 570 - DNA, 300 bp, Homo sapiens
gttctcccttatctgatgctcactgtggccttgggcagcctggcatcgagaattctcagcatgttcactcttgagttctgtgcctgcatcacacagcaatggaacagtcccaaaagattcttaagggtggggaaaggcactaagaaaagatgaacctgcagtccctgttataccatctggtctaattgatactactgttgtcaagcaaaaggagctctctccctgaggcactggaagccaatattttgacaccaggtttttgagaaagaaaagttttttattgtaagttgactcacaaga

SEQ ID NO: 571 - DNA, 276 bp, Homo sapiens
  misc_feature (1)...(276): n = A,T,C or G
gggtggcaagccacccaggtgccgaggcaagagaccgagagcacgagctgttccagtgtaataaaatatataaaataacaagagttatactgatatagctcatagatatgattatatataaataccattaatcattagtttgtagtaattactctttattcaaatattataatnntnctcactctncaatcatnacctanatanngctngnatttgnaannatnntanctgtgnntacatggtgttaactgtttanttccnannattcnttttttt

SEQ ID NO: 572 - DNA, 300 bp, Homo sapiens
gaaagattgaagaagttcatcttcctgtagaaaaagtagatgttatcatatctgagtggatgggctattttcttctgtttgagtctatgttagattctgtcctttatgcaaagaacaaatacttggcaaaaggaggctcggtctaccctgacatttgcactatcagccttgtagcagtgagtgatgtgaataaacatgctgatagaattgctttttgggatgatgtctatggcttcaagatgtcctgcatgaagaaagcagttattccagaagctgttgtggaagttttagatccgaaga

SEQ ID NO: 573 - DNA, 257 bp, Homo sapiens
  misc_feature (1)...(257): n = A,T,C or G
acaacagaacccgaagtgcccaggatgatatttttacacaagctgtaaatatggcaggattgccagcagtgagtatccctgttgcactctcaaaccaagggttgccaataggactacagtttattggacgtgcgttttgtgaccagcagcttcttacagtagccaaatggtttgaataacaagtacagtttcctgttattcannttcttnnactcntggatgattgttnannttnccttgttnntngnaagttncct

SEQ ID NO: 574 - DNA, 300 bp, Homo sapiens
  misc_feature (1)...(300): n = A,T,C or G
attacagccaccttttgggtttcatttaattttggtagtgttaatgtctattaatgtgattttttttttaacctttctcccaataggttgatgacaacaagaaactaggagaatggttaggcctttgnaaaattnacagatagggtnnnccccntannctggtcncntgnnttnntcnttcctatcnntttnanatgnggnancncnntnctntacgttncccnttnttnntnantnntncntattactntccncnttncncnnntncncnttctttgnannnccccntctccctctcgt

SEQ ID NO: 575 - DNA, 300 bp, Homo sapiens
atcaacgcaggcatgtacatcctgagccctgcagtgctgcggcgcatccagctgcagcctacgtccattgagaaggaggtcttccccattatggccaaggaggggcagctatatgccatggagttacagggcttctggatggacattgggcagcccaaggacttcctcactggcatgtgcctcttcctgcagtcactgaggcagaagcagcctgagcggctgtgctcaggccctggcattgtgggcaacgtgctggtggacccaagtgcccgcatcggccagaactgcagcattggcccc

SEQ ID NO: 576 - DNA, 300 bp, Homo sapiens
atgaccagagaggaaggagaagatgcagtccagtttgctaacagggttaagtctgctattgctatacaaggaggcctgactgaacttccctgggatggaggactaaagagagcaaaggtgaaggacatctttaaggaagagcagcagaaaaattacagcaagatgattgtgggcaatggatctctcagctaagaggacggatgacagcctttagatctagaactagcccttagaaatggaatggcttttttgttttgttttgttttattgttttgtttttattattgttaatcttttcta

SEQ ID NO: 577 - DNA, 296 bp, Homo sapiens
  misc_feature (1)...(296): n = A,T,C or G
aagattggggtaatactgaatgtatagtttttagggggtgaaatttagctgtataaatcataggctgttgacatttgtgattacttcattgctaagttttacatataggagtcttcatactttgtttcagggacagaatgatgctgctgaaattggaacaagaaattttagatttcattggtagtaatgagtnagtcctgacnttnnnnagatnntanattgggntcccattctccttgncttctancntggantntnnttttntttngnttnnncctntnnntttntttttgctc

SEQ ID NO: 578 - DNA, 300 bp, Homo sapiens
ggcttctgcaaccaggaccggaggacactcccgggggggcagcctcccccccgggtgtttctggccgtgtttgtggaacagcctactccgtttctgccccgcttcctgcagcggctgctactcctggactatccccccgacagggtcacccttttcctgcacaacaacgaggtcttccatgaaccccacatcgctgactcctggccgcagctccaggaccacttctcagctgtgaagctcgtggggccggaggaggctctgagcccaggcgaggccagggacatggccatggacctgtgt

SEQ ID NO: 579 - DNA, 300 bp, Homo sapiens
tcctattgtaaaatcacttgctaaggctcatgagaggctagaagattccaaactagaagctgtcagtgacaataacttggaattagtcaatgaaattcttgaagacatcactcctctaataaatgtggatgaaaatgtggcagaattggttggtatactcaaagaacctcacttccagtcactgttggaggcccatgatattgtggcatcaaagtgttatgattcacctccatcaagcccagaaatgaataattcttctatcaataatcagttattaccagtagatgccattcgtattct

SEQ ID NO: 580 - DNA, 300 bp, Homo sapiens
ccctatcttatgagaaaagtaactttgaaaggactaatacatcctgttcttagcttctgcttccttcaggccttctctatgaagccagcctattctgctcagcgctttggaacactgattctatttcatggaccgaagcattgcccaattgtagaattgcaataaagccaactgagatctttaaattggctataattcatcctttggcaatacagtaaaaaaaaaaaattctcacaattctgtaaaagggtatgagatatacaataaaagacacccccaccctctgcaatctaccactca

SEQ ID NO: 581 - DNA, 300 bp, Homo sapiens
caaggtcatcgccaaggtgtgattggaaaaattcaaaaaattgcaacctcaggcataaatgggttaaggacatcccaagcccaagtggtacgtgcctcactcagaactgacgggccgagttctatctaggtgtgtcttccagaacctgtttacggctaactggataactgagagacttgtcatttctaaagacatttaagttgctccagggatttctgaaaaaagacacaggcttcttcctagagccagccctatataacatgcccacaagggcaacagttatcacagttcatacacacc

SEQ ID NO: 582 - DNA, 300 bp, Homo sapiens
ccaagacctccacggccttgtgtcaagaaatctccacaaagtgacagtgaatgatggagggggagttctcagagtcattacagctggggagggtgcattgcctcatgaattcttggaaggtgtggagggagttgcaggtggttttatatatactattcaggaaggtgatgctctcttacacaaccttcattctcgccctcaaagacttattgatcatataaggaatctccatgaggaagatgccttactgaaggaggaaagcagcatctatgatgatattgtttttgtggatgttgtcga

SEQ ID NO: 583 - DNA, 291 bp, Homo sapiens
  misc_feature (1)...(291): n = A,T,C or G
ctgcctcagcctcctgagtacgctgggattacaggcgtgcaccaccatgcctggctaatttttgtatttttagtagagatggggtttcacaatgttgcccaggttggtctcgaaccgctgaccttaagcgatccgcctgccttggcctccccaaggtgctggaattacaggcatgagccaccgtgcccggctgacttttttttatcttatttctttgtgacacggggatgtgctcaancttccaggctggantgcaatggcnncncatggntcgntgacntcaatctgctg

SEQ ID NO: 584 - DNA, 284 bp, Homo sapiens
  misc_feature (1)...(284): n = A,T,C or G
agagtgagaacccctctgctacaaaaaatagaaaaaccagctggggcgtggtcgcgctcatgtatagaccagctgctggagagactgagctgggaggatggcttgagcccaggaggccaatnntgtngggagctgnggtcgtacnactgtactctaatctggncnactcgancacganntcntntcncatnactnntntcngtgtntttngngnttttccntnnnttggtntnctnttncattgttcttnctntcnctnattgtganangntctnttcctcctt

SEQ ID NO: 585 - DNA, 300 bp, Homo sapiens
gcagtcaggcagtgactgccttcggctttttttctgctgactaagatctcctatagagagctacaacaatgcccaaaagaaaggctgcaggtcaaggtgatatgaggcaggagccaaagagaagatctgccaggttgtctgctatgcttgtgccagttacaccagaagtgaagcctaaaagaacatcaagttcaaggaaaatgaagacaaaaagtgatatgatggaagaaaacatagatacaagtgcccaagcagttgctgaaaccaagcaagaagcagttgttgaagaagactacaatg

SEQ ID NO: 586 - DNA, 298 bp, Homo sapiens
  misc_feature (1)...(298): n = A,T,C or G
ataagaaattgtcttgcctaagattaaatatatatggatatttttcctaagaaaagttttagaaaagactgatgagtgtatttctatgtaattggaatatatttaaggtcatnccgnntgggnnnnanatnttctnctcacactcagggncntnggggannaacnccngttggnggaagannnccnngnncnacntgtgcagcanctatcccttttcctcacggcngntctccnngnacctcctcgcnntnttnnngcntcccctggngnnnctctgncnncctcccnncattcctga

SEQ ID NO: 587 - DNA, 300 bp, Homo sapiens
ggaagacacaataattttaaattgcctacagcaggggttggcaaatagtggtgcaagggccacatctggctagcagcctatttttgagaatgaagttttatgagaacccacacatctgtttgtagattgctatggctgcctttgagttacagcagtggagctgagtagctgtgacagagactatatgacctacaaaaactaaaaatattggtcctttacagaaaaagttgtctgacccctggcctactatttcaaatcctgggtaggtcctccacgtcagttcttcatggaactgtattg

SEQ ID NO: 588 - DNA, 290 bp, Homo sapiens
  misc_feature (1)...(290): n = A,T,C or G
gtccagcattatggagtgaacgtcagctccaggaagcagagacttctggccctttgttcaccatttccccagaacctagggtggtgactcacctataagtgctcaaaaaacatgtggcgaatggaggaccagagctaggctctgaatgaggcctcctggatctcacgcaggggatggagagtaaggaccagcccctctacctcatgctttcttcctgctgnctcgtangagcccacatncttntgtcctgagcangncanannctgnagnnctgccttgacaggatggct

SEQ ID NO: 589 - DNA, 300 bp, Homo sapiens
ggaaatcatgaaggaaggcaagcagtttcaccggatagtgacataccatcgccacctttatgatatccacgtgactgttcagccaaagtataaacacgtttatcctaagaactctgtagtaagaaaaagccatttgtagggtgcttaagcttgtttgtaaaatggcctacttgaagtcctcatgaataatgagggttgactttcatttgcttgaaacttaaggaagtttgtgcctataaaagttactgcaattcagtatttctttatttttttcgagacagagtctcaatctgtcgccca

SEQ ID NO: 590 - DNA, 296 bp, Homo sapiens
  misc_feature (1)...(296): n = A,T,C or G
ggcgggcgaatgtagtctcagcctcccgagtagctgcgactacaggcgagtgcctccatgcccagctaattttttgnatttttagngnannnggcgnncaatcctgttagaaactgttggagctgcgccgaggcactgaccctgccaccctctactgcattaacttcanccacgactcctccttcctctgcgcttccagtgataagggtactgtccatatctttgctctcaaggatacccgtcttaaccgccgntccgngctngctcncgtgggcaangtggggctatgattggca

SEQ ID NO: 591 - DNA, 279 bp, Homo sapiens
  misc_feature (1)...(279): n = A,T,C or G
ggcaagccctggatgaaaacatggacctcttggaaggtataactggctttgaagactctgtccgaaagtttatctgccatgttgggggcatcanttannatgccntngnccgttgactgntgntntnagaggctctgngttcctnnagggnnanctcnttatanantcttgtntctnngntcttatcagcannntgctntataatcttntgtacctncccntttggtnnagnactnnnnccanataagnattgatgcctanctctcntatnnttattgc

SEQ ID NO: 592 - DNA, 300 bp, Homo sapiens
gtgaaagcggggcctcacgatccttctgaccttttgggttttaagcaggaggtgtcagaaaagttaccacaggggccagaacttccaccttgtggtcaattgtttcaagtgtgtgaccatacttgtcaagaaagtcaagtcttaccagataactgaaaaacagctccaagttctactggcctatgctgaggaggacatttatgatacttcaagacaagccactgcctttggtcttctgaaggcaattttatcaagaaagctgttggtcccagaaatcgatgaggtcatgcggaaagtatc

SEQ ID NO: 593 - DNA, 300 bp, Homo sapiens
gtcggctcttcctatcattgtgaagcagaattcaccaagcgttggattgttcacccactaatagggaacgagagccgaacagctgaagagagttcactgactccccagccccaggtgggccttgtgcacatcatgaccagttttgaagatgctgacacagaagagacagtaacttgtctccagatgacggtttaccatcctggccagttgcagtgtggaatatttcagtcaataagttttaacagagagaaactcccttccagcgaagtggtgaaatttggccgaaattccaacatctgt

SEQ ID NO: 594 - DNA, 300 bp, Homo sapiens
ggaagaaaagtggcagcatgaacagtaagagaatcattacaggctgggtgcagtggctcgcgcctgtaatcccagcactttggtaggctgaggccaggagtttgagaccagcctgggcaacatggtgaaaccctgtccttacaaaaaagttaaaaattagccgggatgtgataccttgtgcctgtggtcccagctacgtgggaagctgcggtggaaggattgcttgagcctgggagatcgaagcttcagtgaaccgtaattgcaccactcccttccaggctggaggacagagcaagaccc

SEQ ID NO: 595 - DNA, 297 bp, Homo sapiens
  misc_feature (1)...(297): n = A,T,C or G
ggatgggcagcccaccatgtgttcagatgggatattatggtatttttcatgtggnattgcctgnnatggtttatatttnncnnnnttttttacangggnntngtattgtttcttannttncntgttttttcgnattntnatnttnncttnnttttttntntntntntttntttngnntnatntttnntttgattcttctatttnnntttcnttnnntttntccttnttagtnnattntntttttntttncattgtnnngtttnttnattttttttttttattnatattttttaatta

SEQ ID NO: 596 - DNA, 265 bp, Homo sapiens
  misc_feature (1)...(265): n = A,T,C or G
ccctgcagacttcttcttggacatcattaatggagattccactgctgtggcattaaacagagaagaagactttaaatccacagatatcatagagccttccatgcaggataagccactcatagaaaaattagctggagatttatganntctccttcttntncnnagagactttagctnnnttacatntncttttnngtnnttnannnaanntntttnnncgnttttttattntgggnttttatttttgttttatttttntntnnat

SEQ ID NO: 597 - DNA, 300 bp, Homo sapiens
tccgcacccaccgtggtgaacgggcccggccaccaccaccatccactctgctgcggccacataacccacctggcccagtacccatggcccctcgaccccgagttcgggcccagccttctggacccagccagccccacgtgtgtggcttctgtgggaaggagttcccccggagctcagatctggtcaaacacaggcgtacacacacgggggagaagccatacaagtgtgcagagtgtggcaagggttttggtgacagttctgcccgcatcaagcaccagcgtgggcacctggtcctgacgc

SEQ ID NO: 598 - DNA, 279 bp, Homo sapiens
  misc_feature (1)...(279): n = A,T,C or G
gagaccttgacaagaaagatgcatcaatcaacatagaaaatatgcagtttatacacaatggcacctatatctgtgatgtcaaaaaccctcctgacatcgttgtccancctggtcacattaagctctatgtcgtnnaaanananantttgtctgtnctannngttttttnntttntnggtnntccangtctttaagnanctctnntnttgnctcatntttnntgctncntnatcntgtgnnagncgtctngtnctnctanntntnnnntttgatcttttt

SEQ ID NO: 599 - DNA, 300 bp, Homo sapiens
  misc_feature (1)...(300): n = A,T,C or G
gaggatatagcgatagagatggatatggtcgtgatcgtgactattcagatcatccaagtggaggctcctanngngattcatangctanntnnggcnccatgactgagcgcntnaccnttncnngnnccctcgncgtcctangcggctggntaacccatatcgctactaccccgcanttcccggacatgatcctctccgcctctcgagcctctagaactatagtgagtcgtattacgtagatccagacatgataagatacattgatgagtttggacaaaccacaactagaatgcagtgaaa

SEQ ID NO: 600 - DNA, 300 bp, Homo sapiens
gctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaa

SEQ ID NO: 601 - DNA, 300 bp, Homo sapiens
gtattaaataagatgtctttaaacagaaacacacatatatgtattgattgattaatgaggctctcaggaacctgactctgtgtttcccctaggagcagtgtttcagtattcactaatcgagtgttcatggtgactttatagaaccactgcaaatagtgagaattaactatacatatatgtttctgtgtgtacgcacatgtgtgtgtatgcatacttgtctctaaacatatgggattatactctgctgctgttttgctctttatgtcattatgtatactatataagtatatttttacatta

SEQ ID NO: 602 - DNA, 299 bp, Homo sapiens
  misc_feature (1)...(299): n = A,T,C or G
gaagtgaatgaaaagaaagacagagttacagatgcccttaatgctacaagagctgctgttgaagaaggcattgttttgggagggggttgtgcccttcttcgatgccttccagtcttggactcattgacttcagctaannnanntnantanatcnntagnntntcaccttttnttttnnananaggcctntttttnntnnnncnttgnnttttctttgggtcnnctntnttnntttnnnncntncctcttttgnntnaanntctttnnnttannttcttttnatttgttttttgggtctt

SEQ ID NO: 603 - DNA, 300 bp, Homo sapiens
cagagaagggacagaacctgacttcaaaatttaatatagtaatcaagaaagtatggtatgggtgagagaatagacaaatagatggaataaaatagagattccagaaagacccacacaactagagtccactgatctttcaaaaaggagcaaaggcaattcaatggagaaaggatggtcttttcaacatggtgctgtaacaattggacatccacatgccaaaaaaagatgaatctagacaccttacatctttcacaaaaattaactcagatcatagacctaaatgtgatgtacaaaagtata

SEQ ID NO: 604 - DNA, 300 bp, Homo sapiens
gagccatgcgagcagctcgttcccttggagaaagaactgtaacagaactgatattacagcaccagaaccctcagcagttgtctgccaatctatgggccgctgtcagggctcgaggatgccagtttttagggccagctatgcaagaagaggccttgaagctggtgttactggcattagaagatggttctgccctctcaaggaaagttctggtactttttgttgtgcagagactagaaccaagatttcctcaggcatcaaaaacaagtattggtcatgttgtgcaactactgtatcgagctt

SEQ ID NO: 605 - DNA, 296 bp, Homo sapiens
  misc_feature (1)...(296): n = A,T,C or G
gtaaactgtatatctgtaatatgaatcccagcttttgagtctgacaaaatcagagttaggatcttgtaaaggaaaaaaaaaccggaccaaaatggagatgagtacttgctgagaatgaatgagggaaggagttggcatttgttgaaagtatagtctttttctctttttttttnaatngcancttttactttaaatttaggaggtcagtncccaggtttgttncatgggtatattgggngatgctgancttggnatncnaangatcctgtnacccaggtanngagtntangccccca

SEQ ID NO: 606 - DNA, 297 bp, Homo sapiens
  misc_feature (1)...(297): n = A,T,C or G
gtcaacatgaagggcaatgacatcagcagtggcacagtcctctccgattatgtgggctcggcgncttccntggncgcaggctttcatcgntatgtntgtctgtngtattntcncttntngnttntnnntntntgntgttttttngtnctttttttctgctntntnntcctttntttntnctnctaggnnnntttntncntttcttantnntttttncttttttttgnnnttntttttttatntatgtngntttntttgtttntannntnttntgnattcnattgnntatngctattt

SEQ ID NO: 607 - DNA, 300 bp, Homo sapiens
ggatctgtttccagtaatagtattcttttttgttccacaaatcatagatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggatttgctcgaatatttgggtacccagtaggtatcgttggaaacaacggagttctcttttctgaatctgcaaaaaagggtac

SEQ ID NO: 608 - DNA, 293 bp, Homo sapiens
  misc_feature (1)...(293): n = A,T,C or G
cagagaagggacagaacctgacttcaaaatttaatatagtaatcaagaaagtatggtatgggtgagagaatagacaaatagatggaataaaatagagattccagaaagacccacacaactagagtccactgatctttcaaaaaggagcaaaggcaattcaatggagaaaggatggtcttttcaacatggtgctgtaacaattggacatccacatgccnnataaagatgaatctagacaccttacatctttcacnaaatttaactcanatcatatnacctantgtgatgtacct

SEQ ID NO: 609 - DNA, 267 bp, Homo sapiens
  misc_feature (1)...(267): n = A,T,C or G
gacggaagtaaattatgatgtccagggggagatggaggataggacgtatttataataggtatatagaacacaagggatataaaatgaaagatttttactaatatatattttatggttgcacacngtacacaccagaagatgntaaattnntttgtggcatttaannctntctnnnnnnttantgcnnntnnnctctaattttttttnnntttgtcntttnnttntcnaaganntnatntnntnnngatnnnttntntanntttcctt

SEQ ID NO: 610 - DNA, 294 bp, Homo sapiens
  misc_feature (1)...(294): n = A,T,C or G
gtcgccttgggcgggagctgagcaaagtgatcattgttgacaattcccctgcctcatacatcttccatcctgagaatgcagtaagtggccccaaagaaagaaaatgtcgtgctccatctgagccctctgtcttgccaggcaggtaccacttttgagcacctacacaagaaggtctctgggccttttcctaatgaaatcccagctctgccatttagcagttgcgtgtcattgaccaagttatttaacctcactgagcctcggntgcctnatctgcanatgggaattataggaatg

SEQ ID NO: 611 - DNA, 297 bp, Homo sapiens
ttaaatcttacttgatcatttagagttttgcttttataaacaagccttttgatacagaggcagaagccagtgaaaaatacttttatagagatgaggtctttttattttatttttttatagagacaaggtcttgctatgttgcttaggctccaacccctggcctcaagccatcctcctgcttaggcctcccagagtgctaggattataggtgtgagctaccgtgctcaactgaaaaatagtttagaagacagtcctactcgacaaatattttctttttcttttctttttttttttttg

SEQ ID NO: 612 - DNA, 262 bp, Homo sapiens
  misc_feature (1)...(262): n = A,T,C or G
ctcggggctccaggctggcttgcccgcgctctttcttccctcgtgacagtggtgtgtggtgccggaaagggtgatggacttagcattcacagacgacaccacacaccactgtcaaataaacagctatttaagggggaaaaaaaaannaaaaaaanaaaaaaaaaaaaaaaaaaaaacanaaaaanaaaaatnaaaaannaantnnnaaancanaanannaatnntanacaaanaaaaaangaggtantnnnnnagcnnacnt

SEQ ID NO: 613 - DNA, 280 bp, Homo sapiens
  misc_feature (1)...(280): n = A,T,C or G
gattctttcccaggccacaagacattttctgctcggaaccttgtttactaatttccactgcttttaaggccctgcactgaaaatgcaagctcaggcgccggtggtcgatgggaccctttgtggagtctgngatgntataggtttattcnanancnttatangctanagtaaannagttaacaanaacnntngnattcattttatgttncaggttcagggggaggtgtgggaggtttnntnnnnnnntnatngnnnnnnntnnnnnnanatnntttttttt

SEQ ID NO: 614 - DNA, 300 bp, Homo sapiens
ctcatctctaccaacaacaacaacaacaaaattagctgggtgtggcagtgtgtacctgtagtcctagctacttggcaagctgaagtggcagcattgcttgagcccaggagttaaaggctgctgtgaattatcattgtgccactatacttcagccagagtgacaaaggaagaccctgtcttgaaataaaaattttttaataaaattaattaactttagttactataacattctttataacctttaaaaaattttaaatttttgactctttttgtaataaacagcttaaaacacaaacacat

SEQ ID NO: 615 - DNA, 300 bp, Homo sapiens
ggcaggaggatggcttgaacattggaggtcgaggctgcagtgaactgagatggcaccactgtattctggcctgggtgacaaagtgagactctgtctcagaaaaaaaatactgtggaaagcctctatgtcccaatatgaaacaatctcctggatatactcttgtggaaaaaagcaacgttccacagagtatatgtagtaagttttatctatgtcagaaagaaggagaaataaaaatatgtgtatgtatttgcatatttttgtaaaaggtagacacaggaaggataaaccaaaaatgcaaat

SEQ ID NO: 616 - DNA, 300 bp, Homo sapiens
gccgacctgtgggacctgatctttctctggggtagggccatcctgggcactgcagggggctgagcagtgtcgctggcctccgcctactttatgccaggagcacccttagtcatgacaatcacaaatggccccagacatcaaccagtgtgccctggagggcagagtctcccctggtgagacctccattcggtcactccctccacccccagggccacgctcaaagcctgtcccagaggagatcctggcctccgcctgatctcctctgaccctttacaaaagtttgctgacccctgacttaag

SEQ ID NO: 617 - DNA, 300 bp, Homo sapiens
cagctcctccaccagcataatgggacccagcatccctgccaaaactcgggaggtgctcgtcagccacctggcatcttacaacacatgggctttacaaggcatgtatggagtttcttgtgggcttggcaggtggctgtgaaggccatcagtgtctgaagcctgtacttgcccctccccaggtcctgtgagtggagaggcacagagtgttctgggctagctgagtgtggaggctgggtggctctgatgctagccaatcactctacgctctaggctcacacctttccaccttcgacttcgcca

SEQ ID NO: 618 - DNA, 299 bp, Homo sapiens
  misc_feature (1)...(299): n = A,T,C or G
ttttttgccttttacctggtcccttgatcatgagttttagctcagataaccaggtattttgaagacgtgattgtccttggccctgccccatcccttccctttaaagggttaaatnttnnncntgccntncctntgnccngaatnccnnnatacnctgcangccntcctgggcaacancacactgagcagaccannangaaacctngggggctttgaccntgtggtctctgatggcttngggggtgnntntgcngtccangacaaccggntannctgnantgncgnttcctacccatgcc

SEQ ID NO: 619 - DNA, 300 bp, Homo sapiens
ttgaaattacaaatcacgcaactgcaacactagaaggcaatcagatttttaacaaccggtttggaggcttatttttagcatctggtgttaatgtgacaatgaaagataacaaaataatgaacaatcaagatgccatagaaaaggctgttagtagaggccaatgtttatataaaatatcaagttataccagctatcccatgcatgatttctacagatgtcatacttgtaacaccacagatcgaaatgccatatgtgtgaactgcattaagaagtgccatcagggacatgatgtagagttta

SEQ ID NO: 620 - DNA, 300 bp, Homo sapiens
taagggatttgtggcataccatcaagccaacccattatacacattatggaaagttcacaagaagaagagagaaaggaatgggcagaaagtttacttaaatagtgacccaaaacttcccaaatctgggaaagaaaatggacatccagattcaagaagactaaaggaccccaaataagatcaacataaacacacaccaagacacattataataaaattgtcaaactctcaaagacagtaagagaattttgaaaacaagaaaaaagtgacttgtcgtgtactagggaacacacatcagactat

SEQ ID NO: 621 - DNA, 268 bp, Homo sapiens
  misc_feature (1)...(268): n = A,T,C or G
gagcagggatcttataaagggccagaaataagatgtgtggttcacatagatagtgagcgtaacatctgtattaaacataggatagaagntttttttngnnnttgattnctccnctngntncngttntnttctnnggttnngtctntnttntnacttttnttnttatnttnngtcttntttntgcttcnatgcttnttnttntnntttnttatttnnccttcnnntnttttntttttttttttntngtttntttncccntctnnntnnt

SEQ ID NO: 622 - DNA, 300 bp, Homo sapiens
  misc_feature (1)...(300): n = A,T,C or G
gataacagcagcctccgctctctcattgagaagccccctattctcagtagctctttcaatcctatcacagggaccatgctggccggcttccgcctccacactggcccgttgccggagcagtgtcatgtgatgcatattcannctgccnaanggangaatangcgcangcgcntanagtaggcggcccnggatcntgggccangagaaanacgnncnagatgngagngngacnagnggnngaatnggggnnanganagtggtgnggnannggagnngagngnnagcgggnngagggggagg

SEQ ID NO: 623 - DNA, 300 bp, Homo sapiens
ctgccttccaacaaaatcgtcaagcgggcagaggagttggtggggcaggagttgccttattcgctgaccagtgacaactgcgagcacttcgtgaaccatctgcgctatggcgtctcccgcagtgaccaggtgcatcttcagcctgcatccccttcccaggagccaggccactccctcagctgccagaggctgggtccctgctggggccagggtgggatggaaatagacatgagcaagacaaaatagcagatatgaaactgttgtccttgagggtgtcacatttggggtggggacaagggt

SEQ ID NO: 624 - DNA, 300 bp, Homo sapiens
gcacaatgtctacccagagatgtttgttcctgacctgacgcccaccttctatggtgccatcaagaacctcggcaccaaccaatgcctggatgtgggtgagaacaaccgcggggggaagcccctcatcatgtactcctgccacggccttggcggcaaccagtactttgagtacacaactcagagggaccttcgccacaacatcgcaaagcagctgtgtctacatgtcagcaagggtgctctgggccttgggagctgtcacttcactggcaagaatagccaggtccccaaggacgaggaatg

SEQ ID NO: 625 - DNA, 300 bp, Homo sapiens
gtcagctcgggcaagccctccgagaagaacctctacgccgacatcgacgccgcgtggcaggcgctgcgcacccggtatggcgtgagtcccgagaacattatcctctatggtcagagcattgggactgtccccacggtagacttggcctcgaggtatgaatgcgcagcggtaattctccattcccctctgatgtctggtttgcgtgtggcttttccggataccaggaaaacatactgctttgatgctttccccagcattgacaagatatctaaagtcacctctcctgtgttggtcattcat

SEQ ID NO: 626 - DNA, 300 bp, Homo sapiens
taacttaaaactgccttttcaatttccagcatgtatagaaaatatgattcgactagaataaagactgaagaagaagccttttcaagtaaaaggtgcttggaatggttctatgaatatgcaggtaggtattcatttgtatcatctaagactgatccttatgacaataaggagtaccttagagatgattaaagaatttaaaaatgtgtacatttcaaatttgggtgtgtgtgtgtgtgtgtccctgttagagggagagagggacatagctgtaacaaatcaccagatagcctattttatagc

SEQ ID NO: 627 - DNA, 278 bp, Homo sapiens
  misc_feature (1)...(278): n = A,T,C or G
gccatgggcactgtgagcctgggccagctccccctgccccccatccctcatgtgttctcagctggcactggctctgccatcctgcctcatttccatcatgcattcagataattgatttttaaagtgtatttttngtattcnggaanacgtatnatnantantcntaattnttataagattnnntttnggnnttttaanntntgtantatnnntatnttncnttntntatttntannanttttntanttnttnannagtnnntnactnttntaatttta

SEQ ID NO: 628 - DNA, 300 bp, Homo sapiens
agaaagcagagtgtgcagttgtgttgactctttgtctcccggtgataaacccatgtgatattttaccaaagtagataatcaaaagaattgaccaaaaaatattaaagcaaagcaaagaaacaaaaggtgatactgccagaagtgaaatttgaatggaacataaatggaattacagaggaaatagcaaagagtgggaatgttggcactgctgttgttccagtgactctagatttgctgccagacaaacttagtgaaagcattgtgacataaaggatgaacaagtgacactggcataagatt

SEQ ID NO: 629 - DNA, 300 bp, Homo sapiens
ggagaatcacttgagcccgggagttctgggctgttgtagtgcactatgccaatcaggtgtctgcactaagttcagcgtcagtgtggtgacttccctggggactcccaggggactgccagattgcctaaggagagatgaactggccaggtcagaaatggagcaggtcgaaactcccatcctgatcagtagtgggattgtgcctatgaatagacactgtattccagcctgggcaatatagcaagatcctgtctctaaacaaaataaaacaaaacataaaaaaaaccccttgtctggaacaac

SEQ ID NO: 630 - DNA, 268 bp, Homo sapiens
  misc_feature (1)...(268): n = A,T,C or G
gggtggcctgtccagctcagcatccttggaagtggccacgtacaccttcctccagcagctctgtccagactcgggcacaatagctgcccgcgcccatttgcgtcattgccccatggtctgcctcagctntgcgnntctgaccntagtggngntnctnattgnnnnncanancccanctatcgtgangatncttnnnttctgtttnngncatngntatntgntcttannattgcatanntntcnnngtncttntttttnntatnnnaaa

SEQ ID NO: 631 - DNA, 300 bp, Homo sapiens
gttcagtgctccccgggattactctggctatcaacgggatggatatcagcagaatttcaagcgaggctctgggcagagtggaccacggggagccccacgaggtaatattttgtggtggtgatcctagctcctaagtggagcttctgttctggccttggaagagctgttaatagtctgcatgttaggaatacatttatcctttccagacttgttgctagggattaaatgaaatgctctgtttctaaaacttaatcttggacccaaattttaatttttgaatgatttaattttccctgttac

SEQ ID NO: 632 - DNA, 300 bp, Homo sapiens
aaaaatatgggctgggattacaggcgtgagccaccacacccagcctttcttttagtgctttaaatatattggccctctgccttctggcctccaagtttctgatgaaaaatctgcttgtcattttattgaggatcccttgtatgtgacaagtttcttccctcttgctactttcaggattctaactttgcatttcaaaagttagactataatgtgtctcagtgtgggtctctttgagttcattttacttggagttacttgagctgcttggatgtttatatgcatgtctttcatcaaatttgg

SEQ ID NO: 633 - DNA, 300 bp, Homo sapiens
ggggtttcaagaacgtgcctcttgggaaggacgtccgctacttgcacttcctggaaggcacccgggactatgagtggctggaagcactgcttatgaatcagacggtgatgtcaaaaaaccttttctggttcaggcacagaccccaggaagcttttcgggaagccctgcacatggacaggtacctgttgctgcacccagactttctccgatacatgaagaacaggtttctgaggtctaagaccctggatggtgcccactggaggatataccgccccaccactggggccctcctgctgctca

SEQ ID NO: 634 - DNA, 300 bp, Homo sapiens
ggcaaaggaactaaagaagcctaatgaagacatgtgcttagcagaccaaaagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacagg

SEQ ID NO: 635 - DNA, 275 bp, Homo sapiens
  misc_feature (1)...(275): n = A,T,C or G
gaaatactttgagcagctctgtggggtgtaaaccttctggtggggactgaaaatggcctgatgcttttggaccgaagtgtgcaaggcaaagtctataatctgatcaaccggaggcgatttcagcagatggatgtgctagagggactgaatgtccttgtgacaatttcaggaaagaagaatagagctacgagtttactatctttcatggccagaacgcagaatactacataatgacccagagngtnaaaatttaaatcanggnctntatcactgtt

SEQ ID NO: 636 - DNA, 300 bp, Homo sapiens
  misc_feature (1)...(300): n = A,T,C or G
actaactgggggattttatttataagggctctagaaaaaacgagttattcacaccagcatcatcttaactaacattctgaactagttagtgctgctttttattntgtntnntcttnttnnnttttnnttnncttnnntttcnantntttntnttntttttatctcttnntntncttntttttntntttctttntntngtntntnnantattctattaggtntntcatttgngtttnctntnttttnntgtntcgctnttcttggncnntnttttnnnnnttatttnntttnttttggttt

SEQ ID NO: 637 - DNA, 300 bp, Homo sapiens
gaacatcccacccccccgcagccagtgctccttgtcaagctccccccgtcactccaggtgggagccaccccggtgagggggtgtgccacttgtccccagggcactcctctgggcatcccgggtgggggattttggggccgtggggggcagtctctggtacctgtgtgcgtcagggatgctctgcacctgcaaccaggtgtcgtccacgggcgggggcatggtaacagtggtcctgttgatgtcaccgatgatgctgagcgcctccttcagcgcgtggtgcatgtgcagcatctcgtcgtg

SEQ ID NO: 638 - DNA, 266 bp, Homo sapiens
  misc_feature (1)...(266): n = A,T,C or G
gaagccagccaacttcttggatcttggaggtggtgtaaaggaagctcaagtatatcaagcattcaaattgctcacagctgatcctaaggttgaagccatccttgtcactatatctggaggtatagccatnanaaggctgcaattaccaaggnatcancaaccnattgcattcatntnatncntcaggttcacgtgnaggcntgggaggtttaantagcaangnntnnnnnacangggctacanncaatnnnccccgtantatcnna

SEQ ID NO: 639 - DNA, 275 bp, Homo sapiens
  misc_feature (1)...(275): n = A,T,C or G
ggaggccacagtaaacctcctcacagcccactggtcctcaagaggtgccacgtctccacacatcagcacaactacgcagcgcctccctccactcggaaggactatcctgctgccaagagggtcaagttggacagtgncagagtccngnnacagatcacnntctanctnaatctncactcannctncagnttncttggncncnngtangnnaatngnaantnnnnnntttntttcnntanatnnttcttnnactnttnnncntngttnattttctt

SEQ ID NO: 640 - DNA, 269 bp, Homo sapiens
  misc_feature (1)...(269): n = A,T,C or G
actacttttatttataaggaaagtttctctattttgtttataaacattaaaccagtgctgtgtgaaggcacttaattggggggaggtgtgggaggtttncangcccntaccacnnntnacnnnccatanccccccattgttgnnaaaaanggggantnganttactancaganntanccacctanntnannncccccnccatgcccncatnnnangnggctgcctntnacgaanannnncctggnnanagnncctannccttnnnattt

SEQ ID NO: 641 - DNA, 295 bp, Homo sapiens
  misc_feature (1)...(295): n = A,T,C or G
aagagtgacaagcattggtaacagtgccttagaactgtgtcagttagtctgatttggaaatcctttatgtaaagctgagactggtcctggttttgttccctttggctacagacctnttgtccnagntctantgtnnccattncggcctttncagntnnntgnattcctccntatcnnntttctntnntncctttatnttcctgttctttattttnnctttanntcctcngtggatctctattnnnttctangnggcctcttcctnnttgganttntnntctntnantccttgtcc

SEQ ID NO: 642 - DNA, 262 bp, Homo sapiens
  misc_feature (1)...(262): n = A,T,C or G
ctgtaaatgacaaaagaaaaagaaaaattgagccttgggacgtgcccatttttactgtaaattatgattccgtaactgacttgtagtaagcagagtttntgnnnncnangnattgtagactttnntatnntnattttnnnnnganttnctttntnaattncttnntaatntnnacattnatgnttcntttannttanngnttantttntattgnttntctnnnnntttttnttnctttnattttttntttacttnttatttt

SEQ ID NO: 643 - DNA, 272 bp, Homo sapiens
  misc_feature (1)...(272): n = A,T,C or G
ggagaattcccttattgctcacttctctgagcttcaaggttctgaagcatccagataagaagttccgggttggccaggccctgagggccaccgttgttggcccagattcctccaagaccctcttatgtctgtccctcacaggtcctcacaagcttgaggaaggggangtggccnnngccgntcggtganngtgatnnannaacnngnnnctcncnnntcctcttcncctntgctnncannnnannancncnctnnttcactgaccgacttct

SEQ ID NO: 644 - DNA, 300 bp, Homo sapiens
gatgtgtctggtgtgggtttcccaagcaaggttccttggaagaagatgtctgcagaggagctggagaatcagtactgtcccagccgatgggttgtccgactgggagcagaggaagccttgaggacctactcacagataggaattgaagccaccacaagggcccgggccaccaggaagagcctgctgcatgtcccctatggagacggcgaaggggagaaagtggacatttacttccccgacgagtcgtctgaagccttgcctttcttcctgttctttcacggaggatactggcagagcgga

SEQ ID NO: 645 - DNA, 288 bp, Homo sapiens
  misc_feature (1)...(288): n = A,T,C or G
ttttgaccttgaaacgatgatcctcaaggtccttctcagcactggtattccctgaaggcattggatgaataacggagattctaacagtctctgttaagacaggatgngtaaagnggncnntgancttnaatnttnttcctntannantttntnngnannnggantncttnatttttttggatngatnnntganattttaanttnttttgtttnnanntngnttnnanannnngcnntttntaggggngtannnttnacttttatttanctntntnnggnattttgttt

SEQ ID NO: 646 - DNA, 259 bp, Homo sapiens
  misc_feature (1)...(259): n = A,T,C or G
gccatcttccagtaattcgccaaaatgacgaacacaaagggaaagaggagaggcacccgatatatgttctctaggccttttagaaaacatggagttgttcctttggtccttatatngcnaatctatntnttnggcnannntntncntgtttttttcnatnntttttttttttttttttttttgntcncnnagntttaataaaatttttttttnanccnnntattannctancntttatntnnaanatannncnattngt

SEQ ID NO: 647 - DNA, 300 bp, Homo sapiens
  misc_feature (1)...(300): n = A,T,C or G
tgcccccagaactgtcctggctccttccgtattaaacgcatttgcattttgagaagtgtccttcccacttcagccctccggagagactaccctagtctttctggggtgnngatgaactaagntgaagcntggcctatntgctgagagggtangancngaagtganannggnntnaatgcccactngaatgaagctgagagagagatctannaaaagctanaactcatgntgtctatctttgaacttggganaaacccacaaggtgctgctgcttatatctgngaagcactancttattct

SEQ ID NO: 648 - DNA, 270 bp, Homo sapiens
  misc_feature (1)...(270): n = A,T,C or G
agcatatgcttgtctcaaattgaaaaacgtattcaagaaatcattgagcagttagatgtcacaactagtgaatatgaaaaggaaaaactgaatgaacggcttgcaaaactttcagatggagtggctgtgctgaaggttggtgggacaagtnctgctttgattcnnttcnnncannngnnncntcntttanntncnttatnnnnccctngnannnncnntncctnngcntnnnnctcnntnnnctntntttcnnnnntcntnttttantnc

SEQ ID NO: 649 - DNA, 300 bp, Homo sapiens
ctgttgatccaagtgtagcctgaagcgaaagaggagccttccagacccatgccatatataaacacacgtgggtgtgcattctccccccacaccttctgtgcaaagctgggagctcactccactgcgtcttgctttttttcacttggcagatcttggagattgttccacatcagtacataaagtacataaagattgtcaccccacaaatacacaccaagtcctattttcatcagcgataaaaaagaaaagttcttgctttccggaagcttgcatgcggctctgagtacccagtgacaccag

SEQ ID NO: 650 - DNA, 281 bp, Homo sapiens
  misc_feature (1)...(281): n = A,T,C or G
tccagtcgcaacggccagacctgacctgccagctccgggcgtggggtgaaatctcttgattcctagtctctcgatatggcacctccgtcagtctttgccgaggttccgcaggcccagnctgnnctggcnttnnagctnactgccnacttcagngaggatacgganccccgcaaggacaanctgcaanngcgagagtatcatggacactnanggactgntgctttcatgtacttccantgntggatcatggtatgacnacattttancnanntgncatttga

SEQ ID NO: 651 - DNA, 273 bp, Homo sapiens
  misc_feature (1)...(273): n = A,T,C or G
gggatcccgagctgtcctgcagctgtaccctgagaactcagagcagttggagctgatcacaacccaggccacaaaggcaggcttctccggtggcatggtggtagactaccctaacagtgccannntatannaatnttcctttgtttnanatntgaccttnttncnntnntnctnttngctntntatnnacttnttcnaaanctncttngngtgntcngttctatctatntatnttntntctcntttcntttntgnanctttgattntatttat

SEQ ID NO: 652 - DNA, 267 bp, Homo sapiens
  misc_feature (1)...(267): n = A,T,C or G
cttgggctgcttattacgctcactattatcaacagcaagcacagccaccaccagcagcccctgcaggtgcaccaactacaactcaaactaatggacaaggagatcagcagaatccagccccagctggacaggttgattataccaaggcttgggatgagtgctncnnnataatggntcnnnnnnnttnnntnncttnttntntaaantnnannnancntgaatttancnnnattcataaacnnnatnnntcnncntnntntaantcta

SEQ ID NO: 653 - DNA, 252 bp, Homo sapiens
  misc_feature (1)...(252): n = A,T,C or G
cccaggatgcccttgagggggccctccgacgcctgcttcaccacctttgacgctggggctggcattgccctcaacgaccactttgtcaagctcatttcctggtatgacaacgaatttggctacagcaacagggtggtgganntnatggccnacatggnctnnatngantatnaanntgggatgtnccnngngnatcnannnnnnncgattcnttnntttnantttctgtntnncnttnaatntcgnntttnt

SEQ ID NO: 654 - DNA, 260 bp, Homo sapiens
  misc_feature (1)...(260): n = A,T,C or G
aagactttctcctaatgcttggaaaaccataactgacatagttctaaatggcacagtcttcgtgacactagatattggaaaacaactaattaaagctcataaaggagcagcattcctttttatttctacnattnntgtnnatactgtatnnnntnantnnttcctatcctnnnnttntnnatttncntntttnnnttattcttnnnntantattgnatttntnanttnaanngnnctgntgnnntttttngnnnttntat

SEQ ID NO: 655 - DNA, 266 bp, Homo sapiens
  misc_feature (1)...(266): n = A,T,C or G
attttcaatttggagcattaactaaatgctcatacacagttaaataaatagaaagagttctatggagactttgctgttactgcttctctttgtgcagtgttagtattcaccctgggcagngagctgccangctttctggtgnnttcttgntcccnctntctattnnnnntncttntccgncnnncctnttcctctgganncttcnttctctnctnntttgtctnnntngnnctnttctnctnnanctttnnntttntcnccnctng

SEQ ID NO: 656 - DNA, 291 bp, Homo sapiens
  misc_feature (1)...(291): n = A,T,C or G
gtggagctacagatgaagatgatggagcttgctaataaatcccttcccaccccaagcttcctttatgactgataactagctccagctgcctttaagttcagtatccctagtgagctgactttccccatcttgctctcttctgcctacttttctgctccntctanacnntgttgnctctcntttagcggcngcctactctanntncnttttngtttangnncctaaananccgggntnacnaatncttgccttgatcntncnnctttnggngttnnntttttaattttggaa

SEQ ID NO: 657 - DNA, 264 bp, Homo sapiens
  misc_feature (1)...(264): n = A,T,C or G
ctttggaaacaatatgcaatgtgaagcggtcgtgttgtgagtttagtaaggctgtgtacactgacacctttgcaggcatgcatgtgcttgtgtgtgtgtgagtgtgtgtccttgcgcatgagctacgcctgcctccactgtgcagacctggtatgtggcatgaacatnaggaaggcctcttttcatgatcatggcntncaanagtgctccgagcncnntctttgncatgatacaaaccgatgctntntgactgatgactctgnt

SEQ ID NO: 658 - DNA, 300 bp, Homo sapiens
  misc_feature (1)...(300): n = A,T,C or G
ttagccaggatggtctcgatctcctgacctcgtgatccacctgccgcggcctcccaaagttctaggattactggcatgagccaccgtgcctggccagcaattagaattttaacactggcagttatgaataatatgaaggagangtnnanatctgannnannntggattagcnntcnnttgngctnctttccgttcatctcatccacagctttctgtgcatcttcatgcctttcaaagcttacaaatccaaatcctttggattttccactttcatcagtcattactttcacacttaaggca

SEQ ID NO: 659 - DNA, 270 bp, Homo sapiens
  misc_feature (1)...(270): n = A,T,C or G
aattagggctgctgtgatattgtcagcttgcattaacaattagaagatagagaacccgccatcagggtgtctacctaacttctcagggactacacttggtagcnttccaccattnanagaacngnnanctannanccntttgccnnnttancccaanngcttnctcacttctcannttccttnngncctannnnnatnntnnnatctttncccctagtncctnccttnncgccatcttctttnntnnnnttgncttnannttnntntcnt

SEQ ID NO: 660 - DNA, 266 bp, Homo sapiens
  misc_feature (1)...(266): n = A,T,C or G
aggacagaaaaatgggtggtattggagggaattttggaaagtaaagtgtatgggttagggactactggacatactgggagtacagtttggttaatgagcctgaagtcctggactaagnggtaagttccatctggctttttaacaggtactaattgntgtgtnnagtnagggagttttttgntnttttnttnnnntntnnntnntcttttttantnttnntctnccacttctccttntttttntnttntcnnttnncntntttttct

SEQ ID NO: 661 - DNA, 266 bp, Homo sapiens
gttaacaagcgtcatgaacaggatgcacgtggtcagcgtcccctacgcgctgatgaaggcgaacccactctcctggatccagaaagtgtgcttctataaagctcgggccgcgctggtgaagtcgcgagacatgcactggtctctcctagctcagcggggccagagggacgtcagcctcagctcactgcgcatgctgattgtggccgatggtgccaacccgtggtcgatctcctcctgtgacgccttcctcaacgtcttccagtcca

SEQ ID NO: 662 - DNA, 300 bp, Homo sapiens
agaagaagcagttgaacagttctttagagttgggtgaaaaaaaatcatagccccaactaaaaatgctggggtcacaattgaagaggaaaaaaattcacaattgacctgaatagtaaattctctaatgtgggatcttgcattaatgaaagatctgggttaagccctcaagtctaatgattgataccaaggaaggcatcctgcagtattgccagaagtctaccctgaactgcagatcaccaatgtggtagaagccaaccaaccagtgaccatccagaactggtgcaagcggggccgcaagca

SEQ ID NO: 663 - DNA, 264 bp, Homo sapiens
  misc_feature (1)...(264): n = A,T,C or G
ctgcactgtgaacctgggcactccgcgccgatgccaccggcctgtgggtctctgaagggaccccccccaatcggactgccaaattctccggtttgccccgggatattatagaaaattatttgtatgaataatgaaaataaaacacacctcgtggcaaaaaaaaaaaaaaaaaaaaaaaaaaaaaaaaaaaaaaaaaaaaaaaaaaaaaaaaaaaaaaattaaatataatttaatannanaaaaannanaanaanntntntanat

SEQ ID NO: 664 - DNA, 147 bp, Homo sapiens
gctcggtttgagggctcggcgcggggtttcctgttcctccttctgcgcggctgcagctcgggacttcggcctgacccagcccccatggcttcagaagagctacagaaagatctagaagaggtaaaggtgttgctggaaaaggctact

SEQ ID NO: 665 - DNA, 280 bp, Homo sapiens
  misc_feature (1)...(280): n = A,T,C or G
aattcaaggcctgtcgagcctctagaactatagtgagtcgtattacgtagatccagacatgataagatacattgatgagtttggacaaaccacaactagaatgcagtgaaaaaaatgctttatttgtgaaatttgtgatgctattgctttatttgtatccattatatgctgcngntaaactagnnancanctacnnttgcnttcattttanntttnagttntntnnntnntttttgttgnttttgttntantttnctntctttatntntttttttttttt

SEQ ID NO: 666 - DNA, 288 bp, Homo sapiens
  misc_feature (1)...(288): n = A,T,C or G
gtaggggaggggctcctttccataaatccttgatgattgacaacacccatttttccttttgccgaccccaagagttttgggagttgtagttaatcatcaagagaatttggggcttccaagttgttcaggtcctctgacaccttttggtatcgttaattttactgatttgtgtagaatgtcagttgtattttaccagctaatatctagaaatgctggcaagaggggtttactccagctttagattgnaggtatgctaccttntttcatacagngnnttannnttactga

SEQ ID NO: 667 - DNA, 163 bp, Homo sapiens
  misc_feature (1)...(163): n = A,T,C or G
tgaaattcagctaaccgagcagctacggtccctcatccccaacgaggatgtgagaaagttcatgtctcatgttatctggaccttgaaaatggaatgttcagaaacacatgtgcaagggagctgtgccaagctcatgtcgcgaacaggcctnctgatgaagctt

SEQ ID NO: 668 - DNA, 262 bp, Homo sapiens
  misc_feature (1)...(262): n = A,T,C or G
ataaaatcgataaggaaaatcgtgaagtcgatagaaatgaaggcctgaaatttgcacgaaagcattccatgttatttatagaggcaagtgcaaaaacctgtgatggtgtacaatgtgcctttgaagaacttgctgaannnatcnttcanacccntggactgtgntaacngtncntntcntcntnncnnttnntacctcttcnnggnnncnntccctattnggnatntnttntngnnnnngnctnanctttttannttttntt

SEQ ID NO: 669 - DNA, 291 bp, Homo sapiens
  misc_feature (1)...(291): n = A,T,C or G
accaagtgcatttagttgaatgaagtcttcttggatttcacccaactaaaagtatttttaaaaataaataacagtcttacctaaattattaggtaatgaattgtagccagttgttaatatcttaatgcagatttttttaaaataaacataaaatgatttatctgtattttaaaggatccaacagatcagtattttttcctgtnatgngatttttnnantttgncncattttannntanttnanntgttnatnttttntctanntcttatntttntngcttatttttttttt

SEQ ID NO: 670 - DNA, 264 bp, Homo sapiens
  misc_feature (1)...(264): n = A,T,C or G
acaagaaaaatgattcaaaaaactgctgagccacttttggataaggaatcaatttcagagaatcctactttggatttaccttgttctatagggagaactgagggaactgcacattcatccagtacctcagatgtggatnnnccgggngcttctnnggctntttannttnnttcnnngtncntnntntgganttnttattctnttncntcgtncantngtgccnttactnttntcntnnnccnntanntgntnnnannggtcntt

SEQ ID NO: 671 - DNA, 261 bp, Homo sapiens
  misc_feature (1)...(261): n = A,T,C or G
gctcactgaagcttaagtgaggatttccttgcaatgagtagaatttcccttctctcccttgtcacaggtttaaaaacctcacagcttgtataatgtaaccatttggggtcccgcttttaacttggactagtgtaactccttcatgcaataaactgaaaagagccatgctgtctaggctacaacnnnnttntnnaannggnnnnnnngctttnngcncccntttgnnnccngnggggaannnnnacccnnnaaccnnttttt

SEQ ID NO: 672 - DNA, 251 bp, Homo sapiens
  misc_feature (1)...(251): n = A,T,C or G
attcatttctctaacagcagtaatattaataattttcatgatttgagaagccttcgcttcgaagcgaaaagtcctaatagtagaagaaccctccataaacctggagtgactatatggatgcccctcaccccacaaccaccaccaccacaataaacaagttgctgacagcggaaaaaaaaaaaaaaaaaaaaaaaaaaaaaaaaaaaaaaaaaaaaaaaanaaaaaaaaaaanaaaaaaaaataaatnntnt

SEQ ID NO: 673 - DNA, 300 bp, Homo sapiens
ctgggtttcaccatattggccaggctggtctcgaactcctgacctggtgatcccctgcctcggcctcccaaagtgccaggattacagacgtgaagcactgcacccggcccacactgtagtttttttagcagacagtttcatggcctacttcactaagtagatggagatatccccccatcttccatggaaatgtctttcttacttgcctcttatttctctatcttagaaaaagaggaatccagtcgggctcggtggctcacacctataatctcagcctcctgagtagctgagactacagcc

SEQ ID NO: 674 - DNA, 267 bp, Homo sapiens
  misc_feature (1)...(267): n = A,T,C or G
accagattgttttgcttcagcctcaggtgatcagactctgagaatatgggatgtgaaggcagcaggagtaagaatcgtgattcctgcacatcaggcagaaatcttgagttgcgactggtgnacatncnatganaatttgctggngancnntncgnttnanttnttttntntttntntnnnntgnctttnntcnnntatttttnntcnttnnntnacncnnntcnagtnngtcnngnatctctnttttgnnnttntntnttgtccgtt

SEQ ID NO: 675 - DNA, 266 bp, Homo sapiens
  misc_feature (1)...(266): n = A,T,C or G
ctccaaggttggctccacggaaaacatcaagcatcagcctggaggaggccgggccaaagtagagaaaaaaacagaggcagctgctacaacccgaaagcctgaatctaatgcagtcactaaaacagtcggcccatttgccaaattgcnntttcntnttnntntatattgtnttntnnttgttttaantnttntncntntaactnntntnnnttcttttnangannttnttnnnatttnntncgtntttttnattnaattngtttntt

SEQ ID NO: 676 - DNA, 300 bp, Homo sapiens
agaaagattctcgcttaaaaaaatgtatttattttatggcaagttggaaaaaatgtaactggaatctcaaaagttctttgggacaaaacagaagtccatggagttatctaagctcttgtaagtgagttaatttaaaaaagaaaattaggctgagagcagtggctcacgcctgtaatcccagaactttgggaggctaaggtgggtggatcacctgaggtcaagagttccagaccaggctggccagcatggtgaaaccccgtctgtactaaaaatacaaaaaattaactgggcatggtagtg

SEQ ID NO: 677 - DNA, 300 bp, Homo sapiens
ggtagaagcagcaaagaaagcccaccatgcagcgtgcaaagaggagaagctggctatctcacgagaagccaacagcaaggcagacccatccctcaaccctgaacagctcaagaaattgcaagacaaaatagaaaagtgcaagcaagatgttcttaagaccaaagagaagtatgagaagtccctgaaggaactcgaccagggcacaccccagtacatggagaacatggagcaggtgtttgagcagtgccagcagttcgaggagaaacgccttcgcttcttccgggaggttctgctggaggt

SEQ ID NO: 678 - DNA, 291 bp, Homo sapiens
  misc_feature (1)...(291): n = A,T,C or G
gagagagagagagagagagagagagagagagagagagagagagagagagagagagagagagagagagagagagagagagagagagagagagagagananngaganagananagagagagngagagagagaganagagagngnnngagannnagagngngncntcatctgctttntcncacgcactcncncctgnccctncgtttnttgnttcctgatctcacttccgtctngctcactctcnctngctggngattctgncctgnnaacnnatactnantttttntcttatg

SEQ ID NO: 679 - DNA, 297 bp, Homo sapiens
  misc_feature (1)...(297): n = A,T,C or G
gagtcaggaaggtaaggcggggagtgactgaataaactctgccttttaaattgagcatctgggccgggcatggtggctcacgcctgtaatcccagcactctgggaggtcgaggtgggacgtgtcatgctgatccagtttgtgaacgtgctgctncaggtcctggtccacaagtcccatgatcttntnnangaggagattggcatcgccatntacaacatggcctcagtcaantttgatggctcgtttgccgnnttnctnccngagttcntgacccnctntnatnntgtngattcctg

SEQ ID NO: 680 - DNA, 266 bp, Homo sapiens
  misc_feature (1)...(266): n = A,T,C or G
gaacctcatcaggaggactgaaggaaaggagccaggctgcagccctctgcctgcccttccgtgccatcatctccaggattaatgaaagggccattcaggaaacagcacagggagctacaaatttacgggttcactggtgattgatcttttcatccagcacaatggacagaagtctaaggaacgtccttgtggtttcctttgggttcctgcttctctttacagcctatggaggtctgtagagcctgcngagcagtcngtacagttag

SEQ ID NO: 681 - DNA, 259 bp, Homo sapiens
  misc_feature (1)...(259): n = A,T,C or G
ggacagcacttagtagctgtggaggaagatgcagagtcagaagatgaagaggaggaggatgtgaaactcttaagtatatctggaaagcggtctgcccctggaggtggtagcacggttccacagaatntagtanaacttgctgctgatgangatgatgacgatgatgatgaagaggnagatnatnnnttgnnnatntncttnntntnttttnnnncnnntgttgntnttttnttncccnnnntnnnataaattgtntttt

SEQ ID NO: 682 - DNA, 295 bp, Homo sapiens
  misc_feature (1)...(295): n = A,T,C or G
cctttgaatgtaaagaatgtggaagatcctttagaaattcctcatgccttaatgatcacattcaaattcacactggaataaaaccacacaagtgtacttactgtgggaaagccttcactagatcaactcaacttactgaacatgtaagaactcacactggaataaaaccctatgaatgtaaggaatgtggccaagcctttgctcagtactcgggcctttctatacacatacgaagtctcagcggnangaanncctatcagtgnnaggnatgtnngannngcntcnctactccctc

SEQ ID NO: 683 - DNA, 300 bp, Homo sapiens
actataggcgcccaccacgacgcccggctaattttttgtatttttagtagagacggggtttcaccaggttagccaggatggtctcgatctcctgaccttgtgatccgcccgcctcggcctcccaaagtgctgggattacaggcgtgagccaccgtgcccggcctacaaatgttaacaaagcaattaccaatggcctttttacatattttttctttaatgaggaataatatgcatgtagaaaagacctacttaaagtcttcatttatattctttcaaatcaaatctttatttaataactta

SEQ ID NO: 684 - DNA, 291 bp, Homo sapiens
  misc_feature (1)...(291): n = A,T,C or G
aatttggctcgcagcgcagccgtggcccgtgcttcctctcactcatcccagacacagggtgggggcagcgtcaccaaaaagcgcaaactggagtccactgagagccgcagcagcttctcacagcacgcacgcactancgggcgcgtggtcgngnaggaggagnncntagggacgtatctgctatgaaaatcccaaanttttcagatagngccctaaaaacaattttatatgccncactggttggtattcttaggntattcccacacttgactttatcattggtactactag

SEQ ID NO: 685 - DNA, 300 bp, Homo sapiens
  misc_feature (1)...(300): n = A,T,C or G
agagagagagagagagagagagagagagagagagagagagagagagagagagagagagagagagagagagagagagagagagagagagagagagagagagagagagagagagagagagagagagagagagnnattnnctctntntnctcctctctctcntttttntccccctnttttcccttntttnttcgntntttntcnttcntcnttctctntctcgtctccnntntnttncntttncctctccttttttcttntctctnttnntccttcctncncttcttgttctcttctttcttt

SEQ ID NO: 686 - DNA, 238 bp, Homo sapiens
gaaatactttgtgcagctctgtggggtgtaaaccttctggtggggactgaaaatggcctgatgcttttggaccgaagtgggcaaggcaaagtctataatctgatcaaccggaggcgatttcagcagatggatgtgctagagggactgaatgtccttgtgacaatttcaggaaagaagaataagctacgagtttactatctttcatggttaagaaacagaatactacataatgacccag

SEQ ID NO: 687 - DNA, 285 bp, Homo sapiens
  misc_feature (1)...(285): n = A,T,C or G
cgagccacaagctgcactgtgaacctgggcactccgcgccgatgccaccggcctgtgggtctctgaagggaccccccccaatcggactgccaaattctccggtttgccccgggatattatagaaaattatttgtatgaataatgaaaataaaacacacctcgtggcaaaaaaaaaaaaaaaaaaaaaaaaaaaaaaaaaaaaaaaaaaaaaaaaaaaaaaaataaannnnnnncnnnaaaaaaaannngggnnntnnnnannaaaannnnaaaaaaaaaaaaaac

SEQ ID NO: 688 - DNA, 253 bp, Homo sapiens
  misc_feature (1)...(253): n = A,T,C or G
cgagccacaagctgcactgtgaacctgggcactccgcgccgatgccaccggcctgtgggtctctgaagggaccccccccaatcggactgccaaattctccggtttgccccgggatattatagaaaattatttgtatgaataatgaaaataaaacacacctcgtggcaaaaaaaaaaaaaaaaaaaaaaaaaaaaaaaaaaaaaaaaaaaaaaaaaaaaaaaaaaaannncnnncntnnaaaaaanttgggggg

SEQ ID NO: 689 - DNA, 262 bp, Homo sapiens
  misc_feature (1)...(262): n = A,T,C or G
ccagcattcaaaattcccatgcttagggaatccattgggacttctccccaggatgtactgaattcaaggaagctttctctaggtgtagcagaaactgctgctgnnatgtctctgctcaccaggacgtnngttctntntacagncctttatttgnttnnnntggnggnantagnttntngnccctggnanctagnnnantggggntnnnannttntggtanttngcgtcatnttcnnttgnnnattacnnnntntgntgcntt

SEQ ID NO: 690 - DNA, 300 bp, Homo sapiens
acaccttcattgtcgtatctccggtgtgtatcagctctccaactctatgtcataattcagttcatggggatcttgattacctttcccttccacaaaatattacactgattggttatatcgatgacattatgctgatttgacctagtgagcaagaagtaggaactacattagacttagtggaaagacatttgcatcagagggtaggaaataaatatgactacaattcaagggccttctaccttagtgaaattggtagggacccagtgacatggggcatgttaggatatttcttctacggtg

SEQ ID NO: 691 - DNA, 264 bp, Homo sapiens
  misc_feature (1)...(264): n = A,T,C or G
atagcactgatgctgggccaacaattagccccatttgtacctttttacaaactttttgacaattgccaagaatcgtccaccttccctccccattgaattaaatacacttcttgtctcatggatactcagaataccaatcaaggtaacagatgcctttattttaactaaggacacagtacagatctcacagggacactccttattccttgcagagtttcagacactactgagggtcaccatagcancntttnatcngaanncnca

SEQ ID NO: 692 - DNA, 300 bp, Homo sapiens
ggataccgtatcgacgtggggcctccggttgctgctaaatgggaaaaacttagcttagtactgatagatgactttattgaaagtggaactgaacaagtactcctactttttaaggactccttgaactcagactgcctgacttcatttaaaataacggatcttggaaaaataaactattcgagtgaaccatcagattgcaatgaagatgacttatttgaagacaaacaagagaatcgttacctggtggttccacctctagaaacaggactgaaaagcacatggaagatctttttgcacttc

SEQ ID NO: 693 - DNA, 282 bp, Homo sapiens
  misc_feature (1)...(282): n = A,T,C or G
atgaaccatctgcttttaatgattttcagaggccagccatttattacatgatgtcattcagggattggtatgagatgcaagatgctggaattacttcagactcaatgatgaagaacttcttctttgtgccttcttgcnttcacntgagccnnanacgctcgcttttcngntgcngcttaaactggccttnccgctnnnntanntntgctnntggacnccccatacgtacgcntcctttnnctnnnngnccaggtcatngatncnttcctnaccntcaaattt

SEQ ID NO: 694 - DNA, 300 bp, Homo sapiens
  misc_feature (1)...(300): n = A,T,C or G
cccaagccccatctcatcctggcacgccctactccactgccctggcagcagcaggtgtggccaatggaggggggtgctggcccccaggattccccgagccaaactgtctttgtcaccacgtggtgctcacttttcatacttccnnaaattacctagnccncgnnntaacatgganngnnctgttgccttanctaanggnacaaccataacctggctgcccatcatgtggtccnacccaatcaaggnnagaatgangaatgctngactgganncccctgganccanatggcnanagggtga

SEQ ID NO: 695 - DNA, 300 bp, Homo sapiens
  misc_feature (1)...(300): n = A,T,C or G
gcctggacactgcaatatacatacatacataaacataaaccggaaatccatatgagcttggaggtagaggagtgggtggtgttggatttggtggtgggtgggaccctttntgggtccttcctggtnccctgagggcncnatnaggagtccnttacttcctttcttccttcatattttacaggcngatgcttttcttataatctaattacatctttttatttgttatatattacaaaccatnacacttataaatacttccnngaantgcttttttgaagtgtgaattaatntnaaatgggg

SEQ ID NO: 696 - DNA, 255 bp, Homo sapiens
  misc_feature (1)...(255): n = A,T,C or G
gccccttgttcatctgtgtcttctgcaaactagtctcatgaagaattctggcgtgcagccagggtagctgaagtttgggtctgggactggagattggccattaggcctcctgagattccagctcccttccaccaagcccagtcttgctacgnggtncatggnataccngactcncttngggcctnanttcncnctttctttttgtgtngntcntaatnnatnantntnttnnntntngttnnntntctccttntt

SEQ ID NO: 697 - DNA, 293 bp, Homo sapiens
  misc_feature (1)...(293): n = A,T,C or G
cgaagctctctacgacatttgcttcagaaccctaaagctgaccacgcccacctatggtgacctgaaccacctggtgtctgctaccatgagtggggtcaccacctgcctgcgcttcccaggccagctcaatgctgacctgcggaagctggctgtgaacatggtcccgttgncnangatgcactnattnntgnccnnatttggccccatgaacagacggnncgnntgtcannatctggccctagnatacggctgnannatacancgtgagacagntgtttncataanagtggctg

SEQ ID NO: 698 - DNA, 257 bp, Homo sapiens
  misc_feature (1)...(257): n = A,T,C or G
gacaacgaaagttacttgggcttcctgaggattacttgtatggacaaactaccacatatctgacatataatgacttcatcaacaaggaacttatcttgttctcaaattctgataacgagagatctatcccttctatggtggatggnttgaacnnttannananaannntnnnntattcataattacanccctnacnnacanntactnanngnacncnanannnnnatnaattacatntnnatnntatnctnnnncnt

SEQ ID NO: 699 - DNA, 300 bp, Homo sapiens
  misc_feature (1)...(300): n = A,T,C or G
caaaggggactatcctctggaggctgtgcgcatgcagcaagatctacgtggatgatgggcttatttctctccaggtgaagcagaaaggtgccgacttcctggtgacggaggtggaaaatggtggctccttgggcagcaagaagggtgtgaaccttcctggngctgctgnggactngcctgcttngtcccacancgnctttcnanntctgntgtctnctnnatntntngtgtggtncntnnntnttncnttannttnctnctactttttngtgangnnncccantgannnaanccttgtcc

SEQ ID NO: 700 - DNA, 255 bp, Homo sapiens
  misc_feature (1)...(255): n = A,T,C or G
ctgaaagtagctaaggcaccccagccggaggaagtgagctctcctggggcgtggttgttcgtgatccttgcatctgttacttagggtcaaggcttgggtcttgccccgcagacccttgggacgacccggccccagcgcagctatgaacctgnancgantgtccnttgangagaaattgancctntgccggangtactacctggtnnngnttngnttnatctnnnngtncttatctgtctnnnncttntcctcatt

SEQ ID NO: 701 - DNA, 300 bp, Homo sapiens
acttggcaaatgttgctaacaaccacaagcagaatttgatgacggtggcaaaccttggtgtggtgtttggacccactctgctgaggcctcaggaagaaacagtagcagccatcatggacatcaaatttcagaacattgtcattgagatcctaatagaaaaccacgaaaagatatttaacaccgtgcccgatatgcctctcaccaatgcccagctgcacctgtctcggaagaagagcagtgactccaagcccccgtcctgcagcgagaggcccctgacgctcttccacaccgttcagtcaa

SEQ ID NO: 702 - DNA, 300 bp, Homo sapiens
gtgaattgcgggaatctttgtctgaagtggaagaaaaatacaagaaagccatggtttccaatgcacagttagacaatgagaagaacaatttgatctaccaagtagacacactcaaggatgttattgaagagcaggaggaacagatggcagaattttatagagaaaatgaagaaaaatcaaaggagttagaaaggcagaaacatatgtgtagtgtgctgcagcataagatggaagaacttaaagaaggcctgcggcaaagagatgagcttattgagaaacatggcttagttataatccccg

SEQ ID NO: 703 - DNA, 262 bp, Homo sapiens
  misc_feature (1)...(262): n = A,T,C or G
tgaggctcagtacgtattcctgcatcagtgcatcctgcggttcctccaacagtcagcccaggccccagccgagaaggaagtcccgtatgaggatgtcgaaaacctcatctacgagaacgtggccgccatccaggctcacaagttggaggtctaantgacgagggggctgnncggnatnncaggcattctcatgctctngacncccantngagnccatatntttngannantanangnnngnnntgnnnnattnntgntntgc

SEQ ID NO: 704 - DNA, 300 bp, Homo sapiens
ggtgaagaaccggatcactctgcaggaagtggtctcccactgcaagaagctgaccaagaggaataaggaacagctgtcagatatgatggttctggacaagcagaagggtttaaagtcgctgagcaaagagaaacggcagaaactagaagcataccaacacctcttctacctgctccagactcagcccatctacctggccaagctgatctttcagatgccacagaacaaaaccaccaagttcatggaggcagtgattttcagcctgtacaactatgcctccagccgccgagaggcctatct

SEQ ID NO: 705 - DNA, 241 bp, Homo sapiens
  misc_feature (1)...(241): n = A,T,C or G
ctatagtgtgcactctgaaatgtactcagtgaaaatttgttttgagtttcattaatgctatttcaccagttagacataattacttctaccgatgtgaatgatacggatgccggcagagcttccagatctttcagactcanctgctaggtcaantactttggnntantnnnantntttnttnaananntgnnctttntttnnncccnnanntanttttanaannnnnnnnanncctttnaaa

SEQ ID NO: 706 - DNA, 300 bp, Homo sapiens
ggaatctggaaaaccaggggctcatgtaactgtgaagaagctgtttgttggcggaattaaagaagatactgaggaacatcaccttagagattactttgaggaatatggaaaaattgataccattgagataattactgataggcagcccggctatcagcccggatgacagtgacgaggagaactgagggcacgtggggtgcggcagcgggctagggcccagggcagcttgcccgtgctgccgtgcagttcttgcctccctcacggggcgtcacccccagcccagctccgttgtacataaat

SEQ ID NO: 707 - DNA, 300 bp, Homo sapiens
  misc_feature (1)...(300): n = A,T,C or G
aattcaaggcctctcgagcctctagaactatagtgagtcgtattacgtagatccagacatgataagatcattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggtttttcctatgggcatgggtggcttcaccaacgtgaactttggccgctcncgctctgcccaa

SEQ ID NO: 708 - DNA, 298 bp, Homo sapiens
  misc_feature (1)...(298): n = A,T,C or G
agacgctggtggccctgtggtgggagaggaaaggaaggagagggtgttggcagtcctttcacactggctttgaagtcctgagatgaggaaattcccagtctggccttgctgggctgtttgctgctttgagtgtgtcctcatctgccggatggtggnggaggctgaattgatcntngnctttcnatatgccangccccttnnatcanngctgctganagcccttctcctcntaatcctntttnnctttcttcttgtnccatnntcctttttgntgcncnctangcntttngntcttgtg

SEQ ID NO: 709 - DNA, 274 bp, Homo sapiens
  misc_feature (1)...(274): n = A,T,C or G
aagaagctgcggaagcccagacaccaggaaggtgagatcttcgacacagaaaaagagaaatttgtgagtccacagcttttaccaaaaatcaaagctattcctcagctccagggctacctgcgatctgtgtttgctctgacgaatggaatttatcctcacaaattggtgttctaaatgtcttaagaacctaattaaatagctgactacaaaaaaaaaaaaaaaaaaaaaaaaaaaaaaaaaaacnnnncccntnaaaaannnngggggggttttt

SEQ ID NO: 710 - DNA, 295 bp, Homo sapiens
  misc_feature (1)...(295): n = A,T,C or G
gatgacctcaacactgcctcttgatttgtttgatgcatgtcactttcattaattttccccctcctttttgaaagtcctgtggcagtactaatattttcattttatgtaatctctggtgctgctttccagtcactgtatgaagtgtctccccaacactagcaaatctaggtcctactaaatacaaatctctgggtggatgatcttctagtactgtatttttaaattaaggagttttagttataatgaaattgatttgtagtctgttttgccgtaaacttgnttttctttaaattgt

SEQ ID NO: 711 - DNA, 254 bp, Homo sapiens
  misc_feature (1)...(254): n = A,T,C or G
gaaaaggcaagcaagccacagacagagagaaaatagtcacaaaacgtatctgacctccacatcctgtaattagaattattgtggtctggtacactgcacccagtttctgcaggagtactttctgggtgtctctattgagtaagagagggccccatgggatattcctacagttcccagatgaacagtgggaaagactctacnttncaantccngggtacntntntctngngncctttntnanngtcnanacnnnt

SEQ ID NO: 712 - DNA, 298 bp, Homo sapiens
  misc_feature (1)...(298): n = A,T,C or G
gagcggccttacaagtgcgatgactgcggaaaggccttgtcccagagcttcgacctcatccgccaccagcggacccacgcggcgggccggcgctgacctggggccccagcaggggtgggaggtgagggcagaagataaggggccagggagctaatngantctttagggaggatatangngngaatccccaatanaatgnaggacnnttatntnctggannannacattgatgctgtaagtgatgtcnggacnnncctggnncctgnncacccagnagnaangnggcanttcttacctg

SEQ ID NO: 713 - DNA, 265 bp, Homo sapiens
  misc_feature (1)...(265): n = A,T,C or G
gaagcacacctttgacagccacacctggaggccgaggagacatgaaatatggcatatatgctgtagagaatgagcatatgaatcggctacagtctcaaagggcaatgcttctgcagggcactgaaagcctgaaccgggccacccaaagtattgaacgtntttatnngnntgttcagagnttgtncttnntggatttntttctttntngnttnanntgggtcgtgttttttannnnctttnttnncntnanntcnggtcgcttata

SEQ ID NO: 714 - DNA, 300 bp, Homo sapiens
ctgatcctccgcttccagaaggagctgaaggagatccagtacggaatcagagcccacgagtggatgttcccggtgtgaagctgcaggctgtgctccagatccaccgacccgtagcatctcgtcacgccagcactcgcctccctaccaatgactcacctgaaattgaaacgggcaggaaatagtctggcagcctctacagcagaagaaacggcaggcagtgcccagggtcgtgcccaggaggctgagcagctgctacgcggtcctctgggtgatcagtaccagacggtgaaggccctagct

SEQ ID NO: 715 - DNA, 300 bp, Homo sapiens
ctgagccaggtgcgggatataatcttgtggtgcgccgttttttaagccggtccgaaaagcgcaatattcgggtgggagtgacccgatttcccagctcagaacctgaggacgcagccatggagcggtcggccttcatggagctggatgctgggagcaggctggtgatgcatctccgcgagtggccagccctgctggtcagcagcacgggctggacagagtttgaacaacttactcttgatggacacaaccttccttctcttgtctgtgtgataacagggtcggtggacctgggtgtctgtc

SEQ ID NO: 716 - DNA, 300 bp, Homo sapiens
ggtgaatgccacacccttcaagattgctcgaggccagatcttgaagatactcacagggaagatagtggtggggcatgccatccacaacgacttcaaagcccttcagtactttcaccccaagtccctcacccgtgacacctcccatatcccccccctcaaccggaaggctgactgcccggagaatgccaccatgtctctgaagcatctcaccaagaagctgctaaaccgggatatccaggttgggaagagcggacattcctctgtggaagatgcccaggccaccatggagctatataagtt

SEQ ID NO: 717 - DNA, 300 bp, Homo sapiens
tttagatgttccagagtcctcagagtccatgaaaggactcacagtggagaaaagccctatgaatgtaaacaatgtggtaaagccttcaaatattctagtaacctatgtgagcatgaaagaactcacactggagtgaaaccttatggatgtaaggaatgtggtaagtcgtttacttcttccagtgcccttcgaagccatgaaaggactcatactggagaaaaaccctatgaatgtaagaaatgtggtaaagccttcagttgttccagttcccttcgaaagcatgaaagagcttatatgtgg

SEQ ID NO: 718 - DNA, 300 bp, Homo sapiens
cggcggcggtggtggcttgtggtgcggcctcaccatacaggaacagggcagacgttagcgtgagtgatcactctcaatcccggggacctggtggccttagtctttcaggtggaacggtgtgcgacatgggaaagaaaaccaagcggacagctgacagttctcctccacccctgacaaccactcaccattttactacttctatctttttgactttccaagaatgtcctagagttggagtggtacagtatgtgggtttccagactggcttctttctagcattatgtactttaagttccttca

SEQ ID NO: 719 - DNA, 300 bp, Homo sapiens
actcagcccacctgcacccaggtgaaataaacagctttattgctcacacgaagcctgtttggtggtctcttcacacggatgcgcatgaaatttggtgccgtgacttggatcgggggacctcccttaggagatcaatcccctgtcctcctgctctttgctccgtgagaaagatccacctacgacctcaggtcctcagaccgaccagcccaagaaacatctcaccaatttcaaatctggcacccactggaaatcagactgcccagctcgcccgacagccactcctggagcccctaaagctct

SEQ ID NO: 720 - DNA, 234 bp, Homo sapiens
  misc_feature (1)...(234): n = A,T,C or G
atacggcgtggagatcagctcctccaccagcataatgggacccagcatccctgccaaaactcgggaggtgctcgtcagccacctggcatcttacaacacatgggctttacaagggattgagtttgtagctgcccagctcaagtccatggtgctaaccttgggcctgattgacctgcgcctgacagtggagcaggccgngctgctgtcactcctggaggangnnttccannntnt

SEQ ID NO: 721 - DNA, 300 bp, Homo sapiens
  misc_feature (1)...(300): n = A,T,C or G
gtggaagaagaaaagtttcctacacaactgagcaggcatattaagtttggtcagaaatcacatgtggagtgtgctcgattttctccagatggtcagtatttggtcactgggtctgttgatggattcattgaactatggaactttactactggaaaaatcanaatggntnttanntnccangcccactntacntntatnangatgnangnnnccagnntacagtcntgatntgtctccagtctccacctnncactgtctggttncngttggtactatangacccatgnntacaacttttgt

SEQ ID NO: 722 - DNA, 261 bp, Homo sapiens
  misc_feature (1)...(261): n = A,T,C or G
gttaattcattcctttccctgaaggagactgggctctgggctccctgcgtggtgaggatgaggagcagaatagagctgcagtcagcagggagcagggctcattctggggagcagagacaaatagagaacagtatctcttgctatatgcagggcactgcaacttacaaatcacagcgcatggcgaggacgagggttggggtggttcctcnnaccatgnntncnnnngttntaccccttnntcnnngnnactctnactnnnaa

SEQ ID NO: 723 - DNA, 275 bp, Homo sapiens
  misc_feature (1)...(275): n = A,T,C or G
gtggcaaagcttcatccagtctaggtcttcaggattttgatttgctccgggtaataggaagaggaagttatgccaaagtactgttggttcgattaaaaaaaacagatcgtatttatgcaatgaaagtttgtgaaaaaagagcttgttaatgatgatgaggatattgattgngtncncnacgganaagcatngtntntganccggcntttnttcatntnntttcccncttnncgnntnntttnctcngcngncccngattttatnnncggtcctat

SEQ ID NO: 724 - DNA, 280 bp, Homo sapiens
  misc_feature (1)...(280): n = A,T,C or G
agaagaatttggtataatcatgaaagccctgtggacaggacagtatagatatatcagtccaaaggactttaaaatcaccattgggaagatcaatgaccagtttgcaggatacagtcagcaagattcacaagaattgcttctgttcctaatggatggactccatgantatnncgntatannngatnncnnnntagcnntnntnnnnntcnnccccanctgactttnnnntnccnnnnnnnnccngctaagnngnttgcnnnntnccccncgcagctccccg

SEQ ID NO: 725 - DNA, 276 bp, Homo sapiens
  misc_feature (1)...(276): n = A,T,C or G
gtgacgcgcatgaatggatgaacgagattcccactgtccctacctactatccagcgaaaccacatgccgttggcaaccacaggtcattcagcgacaagaatggcctcaccagcaagcgggagctgcggcccgaagatgacatgaaaccaggaagctttgacaggtccatacctgaaaacaatatcatgcgcacaatcattgagtttctgctttcttgcatttcaaagaggccgggccntnnaccgntcntgaatttcccngccgancnttttaaaa

SEQ ID NO: 726 - DNA, 300 bp, Homo sapiens
  misc_feature (1)...(300): n = A,T,C or G
ccgtgggactagggcggcgatggtgtcccatgcagagtgccgtcctctgggagtgtttgagtgtgaactctgtacnttgacagctccgtacagctatgtgggacagaagccccccaacacccagtcgatggtgaatgcagtttattctactccaagagattctgcctcccttgtgtccgggagaacatcaatgcttttcctcaggaaattcggcaagacttggagaaaaggaaagctccatcaaagaggacccccagccagcccggttctcggacgtgagtgcaactggggctaggtcat

SEQ ID NO: 727 - DNA, 300 bp, Homo sapiens
  misc_feature (1)...(300): n = A,T,C or G
ggaagctccacgtgtagctgagctgcatgcaccaggcctcagtttgccccaagtcccctgtgtactctctcatggcctgtggccaagaaatgtattctctcactttggacttaggagtccaaagagaagcccagaaacaaaattgcttgaacttgaatttgtgtgcgtgcgcacgtgtgcacgtggtggtgaancnatattnnttccaccnntggctnatnccatggcaccttcaaggcttgatancggnaatcttgtcatnaatggaaatcccatgncttcttncangatcgagattcc

SEQ ID NO: 728 - DNA, 298 bp, Homo sapiens
  misc_feature (1)...(298): n = A,T,C or G
gttattgctctcggtgttcctaatcctcggacttccaatgaagttcagtatgaccaaaggctcttcaaccaatccaagggtatggacagtggatttgcaggtggagaagatgaaatttataatggttatgatcaagcctggagaggtggtaaagatatggnccagngcatttatatggcnnnatannnatctgccnnagaanatgtatggccgatgnccgtntncgncaccntgnttnatnannanatncntnnaccacnctgnannntntgtttcnnancccncnccgactttggat

SEQ ID NO: 729 - DNA, 245 bp, Homo sapiens
  misc_feature (1)...(245): n = A,T,C or G
gcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtngggatggctttcntgnattngttncttannnangtatntntnnnaannntgantgttannnttttttntnncttttnttnanttntnt

SEQ ID NO: 730 - DNA, 299 bp, Homo sapiens
  misc_feature (1)...(299): n = A,T,C or G
atttgaagcaccaaaccaggagaaagtttcagactatgaaatgaagttgatggatttagatgttgaacaacttggaattccagaacaggagtacagctgtgtagtaaagatgccttctggggaatttgcacgtatatgccgagatctcagccatattggagatgctgctggannnnnntgngcntgngacnggnnnnngncntctgcatntgcannatnngctaagncnactttnatggcntctttgncgccttcctnccatagttncngaccagctgtnatggtgtggatgcctgcct

SEQ ID NO: 731 - DNA, 298 bp, Homo sapiens
  misc_feature (1)...(298): n = A,T,C or G
agacgcgctcctgcgccggtatttctgggaaaagccagcttctgtttgcactggtcttcacaactcgttacctggatctttttacttcatttatttcattgtataacacatctatgaaggttatctaccttgcctgctcctatgccacagtgtacctgatctacctgaaatttaaggcaacctacgatggaaatcatgataccttccgagtggagattttggcgtgtcctnncccatgncactgnattttatanccttgtgactgtgtcatatanatanctncntatatatatacata

SEQ ID NO: 732 - DNA, 300 bp, Homo sapiens
gtttgaaatgaatgcaatattaatagatgcatatatacatgacatattgtggttaattttaaaactactgtgccttaacgtgtttcttaaacttttgtagtaaatgaacatttgaaatccattttgataaacctgctgttaatgttttttccccccttgtgaatgttttctaactttgtcttggtaattgcaatttaactaggtgcggtggctactaaagttcgaaggcacgatatgcgtgtccatccttaccaaaggattgtgaccgcagaccgagccgccaccggcaactaacctatg

SEQ ID NO: 733 - DNA, 267 bp, Homo sapiens
  misc_feature (1)...(267): n = A,T,C or G
cattaaactcccacagtggtcaccccactgctgatgtacagactttccaggcaaagcgccatattcatcaacaccgtcagtcttactgtaattataacactggaggtcagttagagggcaatgcagccacttcctatcagaagcagactgacaaacccagccactgtagccagtttgtgacaccttcgtggatgangagacagttctctgtacccantctnaaagctggtnnanaaccacngnntanntnagatatttgngccaact

SEQ ID NO: 734 - DNA, 300 bp, Homo sapiens
tcactgatggtttgctgtttggaagccattggcagggctgccgtgcatgtggctgtgagggctgcacagtcctgccaaggggcttcctccttgtcaccccgaaccttgtaatcgtgtgctggcgtggcagccctggctaagttaatccccaccgctttcagtggtagaaagaattccctgagtgggccaggctggtgccctcctcctaccctggcttttctgagtgagctgcctggagccctcatcccctctcccaggctgggctggccctgggcggggccactgtgtgctggcccactg

SEQ ID NO: 735 - DNA, 300 bp, Homo sapiens
gtgactccaagcccacgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcactccccccgaatccaagcccaacttcacccctctcgccatcttggcccatgttctcggcgccatccagccctatgccca

SEQ ID NO: 736 - DNA, 281 bp, Homo sapiens
ccgggctgaacagcctcaccagcatgccatgtactacctccgcttgctgatgactgaagtggcctggactaaagatgagttaaaagaagctctggatgatgtaacccttcctcgccttaaggccttcatacctcagctcctgtcacggctgcacattgaagcccttctccatggaaacataacaaagcaggctgcattaggaattatgcagatggttgaagacaccctcattgaacatgctcataccaaacctctccttccaagtcagctggttcggtata

SEQ ID NO: 737 - DNA, 295 bp, Homo sapiens
  misc_feature (1)...(295): n = A,T,C or G
gccacagcagcagccacagccgcaggcgccccagcaaccacagcagcagcagcagcagcagccaccaccatcacaacagcctccaccaacacagcagcagccacagcagtttagaaatgataacaggcagcagttcaattcaggtagagaccaagaaaggtttggaagaagatcttttggaaatagggtggaaaatgatcgggaacggtatgggaaccgtaatgatgatagngatantagtnaccgtgacnggatagagngnggnagnagnnnttttttnttntatntttttttg

SEQ ID NO: 738 - DNA, 300 bp, Homo sapiens
cagacagccaaacagaccttctgtttcatgaacaggcgtgttatatctgctaacccatatctagggggcacctccaacggctatgcccaccccagcgggacggcacttcattatgacgatgtcccgtgcatcaacggctcgtgggaaccggaagacggctttcctgcttcctgcagcagaggcttgggagaagaggtgctttatgataacgcaggcctgtacgataacttgccgcctccgcacatctttgcccgctactctcctgctgacagaaaggcctctaggctgtctgctgacaag

SEQ ID NO: 739 - DNA, 300 bp, Homo sapiens
tctgggccctaggcctccacaggagcaagtggggcctctgatggtaaaagtcgaggagaaagaagagaaaggcaagtaccttcctagcctggagatgttccgccagcgcttcaggcagtttgggtaccatgatacccctggaccccgagaggccctgagccaactccgggtgctctgctgtgagtggctgaggcccgagatccacaccaaggagcagatcctggagctactggtgctggagcagttcctgaccatcctgccccaggagctccaggcctgggtgcaggagcattgcccgga

SEQ ID NO: 740 - DNA, 299 bp, Homo sapiens
ccgatacgaggcaaacggggaagttaagcaaagaccaattcgcgttagctatgtatttcattcagcagaaggtcagtaaaggcatcgaccctcctcaagtcctctcgccggacatggtcccgccttcggagagaggcacgcccggcccggacagttcaggctctctcggctccggggagtttactggcgtgaaggagcttgattgacatcagtcaagagattgcccagttacaaagagagaaatattcactggaacaagacattcgagaaaaggaagaggcaatcatgacagaaaacca

SEQ ID NO: 741 - DNA, 300 bp, Homo sapiens
ggatagcccacctcatgttcctgtacctgaactctcaacagacactgttataaatgtgatcactaatatgacaaccaccatccagagtctctttccaaatctccaggttttccctgcgctgggtaatcatgactattggccacaggatcaactgcctgtagtcaccagtaaagtgtacaatgcagtagcaaacctctggaaaccatggctagatgaagaagctattagtactttaaggaaaggtggtttttattcacagaaagttacaactaatccaaaccttaggatcatcagtctaaa

SEQ ID NO: 742 - DNA, 300 bp, Homo sapiens
agttaatgcgccagaggcagcagcagcaagaggctctccggaggttgcagcagcagcagcagcaacaacagctggcgcagatgaagcttccttcttcttcaacgtggggccagcagtccaatacaacagcatgtcagtcccaggccacgctgtcgttggctgaaatccaaaaactagaggaagaacgagaacggcagcttcgagaagagcaaaggcgccagcagagggagttgatgaaagctcttcagcagcagcagcagcagcaacagcagaaactctcaggttgggggaatgtcagca

SEQ ID NO: 743 - DNA, 300 bp, Homo sapiens
ggaacgaggctttgctccatggaagtgtctaccagtctgagtacatagacctctctgaaaaaattaaacagggagatagtagcctggagtttggcatcaaacctggtgacccacgcgttctgcagaagttagatgacgatggattgccgtttataggagcaaaactgcagtacggagatccgtattacagctacctcaacctcaacaccggggaaagttttgtgatgtactataagagtaaagaaaattgtgttgtggataacatcaaagtgtgcagtaatgacactgggagtggaaaat

SEQ ID NO: 744 - DNA, 300 bp, Homo sapiens
ggcagtcatcaggacctcagtgtgatacagccaattgtaaaagactgcaaagaggctgacttatccttgtataatgaattccgattgtggaaggatgagcccacaatggacaggacgtgtcctttcttagacaaaatctaccaggaagatatctttccatgtttaacattctcaaaaattggcttcagctgttctggaggctgtggaaaacaatactctaagcattgaaccagtgggattacaacctatccggtttgtgaaagcttctgcagttgaatgcggaggaccaaaaaaatgtgc

SEQ ID NO: 745 - DNA, 300 bp, Homo sapiens
aaccaacactgatggcagcagttccggaaatcatggatcggatctacaaaaatgtcatgaataaagtcagtgaaatgagtagttttcaacgtaatctgtttattctggcctataattacaaaatggaacagatttcaaaaggacgtaatactccactgtgcgacagctttgttttccggaaagttcgaagcttgctagggggaaatattcgtctcctgttgtgtggtggcgctccactttctgcaaccacgcagcgattcatgaacatctgtttctgctgtcctgttggtcagggatacg

SEQ ID NO: 746 - DNA, 300 bp, Homo sapiens
ccgatacgaggcaaacggggaagttaagcaaagaccaattcgcgttagctatgtatttcattcagcagaaggtcagtaaaggcatcgaccctcctcaagtcctctcgccggacatggtcccgccttcggagagaggcacgcccggcccggacagttcaggctctctcggctccggggagtttactggcgtgaaggagcttgatgacatcagtcaagagattgcccagttacaaagagagaaatattcactggaacaagacattcgagaaaaggaagaggcaatcagacagaaaaccagcg

SEQ ID NO: 747 - DNA, 300 bp, Homo sapiens
gggactcgttaccatcactcccaccacaggctccgatgggcgcccagatgcccgggtccgcctcgaccgcagcaagatccggtctgtgggcaagcctgctctagagcgcttcctgcggagacttcaggtgctgaagtccacaggggatgtggccggagggcgggccctgtacgaggggtatgcaacggtcactgatgcgccccccgagtgcttcctcaccctcagggacacggtgctgctgcgtaaggaatctcggaagctcattgttcagcccaacactcgccttgaaggctcagacgt

SEQ ID NO: 748 - DNA, 300 bp, Homo sapiens
atacagcagagcctagaacaagaagaagctgaacataaggccacaaaggcacgactagcagatgggaaataagatctatgagtccatcgaagaagccaaatcagaagccatgaaagaaatggagaagaagctcttggaggaaagaactttaaaacagaaagtggagaacctattgctagaagctgagaaaagatgttctctattagactgtgacctcaaacagtcacagcagaaaataaatgagctccttaaacagaaagatgtgctaaatgaggatgttagaaacctgacattaaaaat

SEQ ID NO: 749 - DNA, 300 bp, Homo sapiens
gaaaccctatgtgtgtgataggtgtgggaaggccttcaggaacagctcaggcctcacagtgcataaaaggatccacacaggtgagaaaccctatgaatgtgatgagtgtgggaaggcatacatctcacactcaagtcttatcaatcataaaagtgtccaccaggggaagcagccctataattgtgagtgtgggaaatccttcaattatagatcagtccttgaccagcacaaaaggatccacactggaaagaagccataccgatgtaatgagtgtggtaaggcttttaatatcagatcaca

SEQ ID NO: 750 - DNA, 300 bp, Homo sapiens
ctattactcggcttcttagcattcgcattcctgctctcttacccccagcgtccacagagctggatgttcctcacaatgtccaagtggctgcagtggttggcattggccttgtatatcaagggacagctcacagacatactgcagaagtcctgttggctgagataggacggcctcctggtcctgaaatggaatactgcactgacagagagtcatactccttagctgctggcttggccctgggcatggtctgcttggggcatggcagcaatttgataggtatgtctgatctcaatgtgcctg

SEQ ID NO: 751 - DNA, 300 bp, Homo sapiens
gaaattctggtcctcccttccgagcaacgtttgcaacgatgagaggatggctgcaggaaacggcaatgaggatgactgttggaatgggaaaggcaaaagcaggtacctgtttgcagtgacaggaaatggattagccaaccagggcaacaacccagaggtccaggttgacaccagcaaaccagacatactgatccttcgtcaaatcatggctcttcgagtgatgaccagcaagatgaagaatgcatacaatgggaacgacgtggacttctttgatatcagtgatgaaagtagtggagaagg

SEQ ID NO: 752 - DNA, 292 bp, Homo sapiens
  misc_feature (1)...(292): n = A,T,C or G
aaattagctgggtgtggtggtgcacgcctgtgatcccagctacttgagaggctgaggcaggagaatcacttgaactcgggaggtggaagttgcagtgagntganatcgtgccactgaangatccnnntgagcnacanaatgagatnccatcncaaanttcagtacctanatccttannttagagattgtnttganacntnaanntcctggaccttatctgnngctcccctangctngngtnnctntnannttntttntantnngcntnttgctnanatnatantccagtgca

SEQ ID NO: 753 - DNA, 290 bp, Homo sapiens
  misc_feature (1)...(290): n = A,T,C or G
aattccgttgctgtcgggtttcaccatgttggccacgctggtctcgaactcctgacctcaggtgatccaccctcctcggcctcccaaagtgttggtactacaggtgtgagccactgcgcctggctggatctaactttttttcctccttggtttactcgctcactttgatggattatgttgtcttgtgttttcccnntattagaantcangggaaatgantnttttganaactttcatatgtggctganttnttgatcnatcntttaannnanatnagnatnnttctgact

SEQ ID NO: 754 - DNA, 259 bp, Homo sapiens
  misc_feature (1)...(259): n = A,T,C or G
aattccgttgctgtcgctgattaatgcactttgaagttctctggaattaattattttaacttggcctagcttcgactgtcaaggtggctgttataaatttgactcnattgtnagnggatgaancctaagtcagctnangactnnatcatatntttnccntgangnctgtctgctngctcatgtatnacttnctntatcnanttgacngntnnnnattctganntgntggtntgtactntacnacaatcagagctgccct

SEQ ID NO: 755 - DNA, 257 bp, Homo sapiens
  misc_feature (1)...(257): n = A,T,C or G
aattccgttgctgtcgcaaactcctaggctcaagcggtcctcccactgtggcctcccaaagtgctgggtggtgtgagccaccgtgcctggccagttaatttnttttancgtanntntttttnnttctnatatttatcngntgcnnnctannntnanattanntntttnanatnnncnccnttcnnnnnnaccngtgnnttngcatttnannttttctaantatnttaancntgatnattttnctgtnaanttttnna

SEQ ID NO: 756 - DNA, 234 bp, Homo sapiens
  misc_feature (1)...(234): n = A,T,C or G
aattccgttgctgtcgaaaaggcttataacttagggtttagagaacagttatgaggcattctcattgctaaatcatgctctggggaagtctgccatttaatatgtcatagactagggctacctagttgttactgatggtgtttgagctgaagaaaatgcgtgtgtgtttctgtaaggtaagaggagcttgacattcactaaggagataatgaggcattgacaggctgnnntgna

SEQ ID NO: 757 - DNA, 300 bp, Homo sapiens
  misc_feature (1)...(300): n = A,T,C or G
ctactccttctttttgcaggcatcccatttnattcgaattccgttgctgtcgctttataatgcaatttccagaccctttatcatccttgctcttgatagctgtttgtcagcatccctcttaaaatgtggttcccaggagtggacatgctgtgtcaacatatacactgagacagttgacctctttgttctgggccgagctcattaacttagggactgggggtccagagtgtctgtcaagtccctgaaattaactgtaaatttttgtatgtctagacatatttatgggaggaaaacttattg

SEQ ID NO: 758 - DNA, 300 bp, Homo sapiens
aattccgttgctgtcggcggtataaaagtagctgtgttggatggtaaacacacaggcccgattacctgtttgcaattcaaccccaagttcatgacttttgccagtgcgtgttccaacatggccttttggttgcccaccattgatgactgaccctgttgctgcttggctatttctgtatagtgagggcggccagcaggaagaaactcagagggaactgagataatagtgggattggatcatttgactgggctggagaacatccttttacatggccttcccatggatgtgctgtacatctgc

SEQ ID NO: 759 - DNA, 300 bp, Homo sapiens
cgttgctgtcgggaatccctgccaaggtaacttgacagtcggcctaattctgttgacagaaaatgaagccttgacggttctaattatccaaaagtgggttttcatcaggacgtacagtcagagtgtgagtgcattctaatgaaaacttcttcagccctcattcaattgcatacaaaagccctcaaagagaacatacagtacagcagttttgtaaaaggcaacaatacgatttgtacagaccccgacactccaatcctatagatcaccacgttgctcctctgtccccagcaccccttattt

SEQ ID NO: 760 - DNA, 300 bp, Homo sapiens
aattccgttgctgtcgaaatttgtttagcttctcaattcatgttccttagaggatggtaaattaaagttagcattcctggacagagcctttcatacattgaagacaacccggtgagtctcaaggggagaggtgtgggagagatgaaaggatttctccaggcctgttcggcagcatggactgttcttttaggtaattaagggagaccatagaagacaattgtgtgagtccatttacctttcacttgggggtcttaagtctttggttgggcttctttaaccctgtgtgtcacccacggactc

SEQ ID NO: 761 - DNA, 300 bp, Homo sapiens
aattccgttgctgtcgctccatttgacttgcaaaccagccttttctaataggctaatattgctgaggccttaaaggaaatggacaaaaattatccagaaggggtacttttccattgtatctttctaataagggtttaaaatggtactattatggtattgtacttgggctttaacatcaatgttgctttgatgttgttggatataaataggaatttttacacattactattgtgaatggtgaatgttcatgtatgacctacttgtaattaacttgagttgtagtccacagcctcaggacaa

SEQ ID NO: 762 - DNA, 293 bp, Homo sapiens
  misc_feature (1)...(293): n = A,T,C or G
aattccgttgctgtcgaaacgcagtaatgcatgaagagtgccgggcatggtgctgagccctgttcctgctctccctccagggctgctgagctagaattcccacctatgtctttccaagggactgttcacggcttgggacttggtctctgtcctgccccatcctcgtcacttgagaccacgagccctggttcagncaccnagngaagccacccatcggctcatgaatcntnaanncttnangcancnnatgcctngcngcntggaatnancttanngntttgacctgatgcacc

SEQ ID NO: 763 - DNA, 300 bp, Homo sapiens
aattccgttgctgtcggagagacctagcaatgtgaagtaacaaagatcaggcagctgcaagtgactcctgaatcttgagtccagggctttcgccactacagtacagtggttttcttttctttggtcggggagagtgggctggaatggagagtgaggcccacaaattacctgcagagacgtggaggcgtgagggagaacatgcttgttaaatatgcaggtagattaggagacaccaaacagagattcagacacagtaaggctgggatgagatcctcgaagctgtgttttaacaaactccac

SEQ ID NO: 764 - DNA, 300 bp, Homo sapiens
aattccgttgctgtcgcttgtcctgttgtgatcagagtttcacaaagtgctctcagtgcctaaggcaaactggcacattctctatgaaaaagacaattattgttcttggtcaggtggccagttggcccagttgattttggagcatagtgttaataaaggttagtctcttcagatatgagccagttgacttggctatataaatagctgctgtcacgggcaggtcagaggtatgtgtgtggatagactggatctgtaaccaccaatcagaaatcaatcagcaatcatttactgagcatttgc

SEQ ID NO: 765 - DNA, 300 bp, Homo sapiens
aattccgttgctgtcggctctacgatggagtcaaggccagattgggctctatttccacaaccccctaaggagtagctcaccagtgtcctaagtggctgtttcctgggtgaacatagtacatatttgctgtcacgctgggaataccagtgagaatctcatgcatggacagaggacatgatcatctttatgtttgtaacctcgggcctggaacagtctccttttgtgttcacttgattctgaaaggtcagtgttttagaacaggcttttcacatggttcaccaggaggccagttagatcctg

SEQ ID NO: 766 - DNA, 265 bp, Homo sapiens
  misc_feature (1)...(265): n = A,T,C or G
aattccgttgctgtcggtgagaaagtatgccactctttaattagctcttataattggagggttattccctgagtagagattaaaagctggggaaatgttgaatcctacaaaattcttgtgttgccgtcactccaggttgctacaacactttagatattcgtatgagggagtcatatttgttttacactaacnggaaactatgacaataantatatgagtancnncattatantncttnanaatccaccaagtgagnnnctgctat

SEQ ID NO: 767 - DNA, 296 bp, Homo sapiens
  misc_feature (1)...(296): n = A,T,C or G
aattccgttgctgtcggttactgagttagtactgtataatgtagtgagtagtgatgatgagcatggattgattattggcttatcttctttgtttttttgcttttgattttctttattttnttttganangcattgncctantgaacntnnaaactgaattaaggncccccnnnannnncacttncnntntnccnngggaaaangcnccgaacccccatntnaaanncaccagctccaacacacgantancnttnatgagganttggctnacnatgagaanccccgaaagaagtaac

SEQ ID NO: 768 - DNA, 267 bp, Homo sapiens
  misc_feature (1)...(267): n = A,T,C or G
aattccgttgctgtcgggtaatttgacactgctgctggcagtagttctctattcaccattttaaagcccattcaggttctctcttcctgaaaagaactgattgctgtgtttacatgaaatgacattggagtcagatggtctgttttaaagatttctatgacagcctattttcctgagttgnananattggaggttccctgnntcnnntaaaactgaanaacgcnnngnaanaggcnatgancgatctnctgcnnagggcntttgatg

SEQ ID NO: 769 - DNA, 269 bp, Homo sapiens
  misc_feature (1)...(269): n = A,T,C or G
aatttcgttgctgtcggacccagcaaattttttgtatttttagtagagatggggtttcaccatgttggtcaggctggggtcttaccacccccttgaaagcctaccncccnccncggcnnctnnaanagccnnnagtntangnnagtncnaccnnaccnnnnctanncncngtccnnntccatgnggncntatacccatncatnctacnccatctctncncccnnncagtcatcnctaccntntctcacaaactccnccnntncttnang

SEQ ID NO: 770 - DNA, 300 bp, Homo sapiens
aattccgttgctgtcgggtttctgtagaggaatgtcttccaggtgggagaagaatggctttcatttttaacaaccacacactataaacaaagcatcccgagagcacgggtacctagcagaagaagaacgaagtagccaggaaacaagttgcttttcagcatccccactgaaatgatagggtactttagaaagcgggtggtggcattctttccacaagtacagcaagtgtcactgtggggtcttaattctctcgaatctgcctttagaaggcagaaggcagaatgatcagctctgctctga

SEQ ID NO: 771 - DNA, 300 bp, Homo sapiens
cattgatgtgcaaataatgagattccctatctccttttagacctgggacggcaaaagggaagggaaggaaacttagcagagtgctattgactatagattcacatattagcaacaaaatcccgtaattcttttggccaacagcagctattttggggagcagctgtggctgttacataaatagagatgcagccaaaattttaggccttttatcctgcttctagcagaaaaatgcagggagagtcaagtagtctagggtttcaggttgcctcccctcatatggtttttggccaagtgactaaa

SEQ ID NO: 772 - DNA, 206 bp, Homo sapiens
  misc_feature (1)...(206): n = A,T,C or G
aattccggtgctgtcgctgattatccgaatgagtaagcagatgtctcactatgtggatggtccgttacctgggatattctgggntnctgtagntgaactatgacagaggaaccagantcataatgangcntctgatnaggngaggcgtatngagannatnnctccnnccnttanctncctnacantntaaattnntaatatacatt

SEQ ID NO: 773 - DNA, 300 bp, Homo sapiens
aattccgttgctgtcgaaaaaggtcattcccagtctttttagactcctgttttccagggagacatcctctgatcctttgagcttcatgatgaatcacctgaattctgtaggcgacacatgtggactagagcagattgatatgtttatacttggatactcccttgaagtaaagataaaagtgttcagactgttcaagtttaactccagagactttgaagtctgctacccagaggagcctctcagggactggccggagatctccctgctgaccgagaacgaccgcactaccacattccagtc

SEQ ID NO: 774 - DNA, 300 bp, Homo sapiens
aattccgttgctgtcggtcacttatgcctataagcgggcatacaacaggggcacaataaatgtttgttaagtgaatgagggctttgagaactagatgggatcttagtccaactctcttatttaacgaggtccacagaggttctgcgattgtctaagaaagaaggctgtgttcatggcctttgttgtttacgtggccctgtgattctcttggctccgtgaaagtcctgatgcagacattccggccatctagaaaggcatgcagacaagccatccagctggcatgatcctgagtccagcttt

SEQ ID NO: 775 - DNA, 300 bp, Homo sapiens
cagagcgtggcaggagctcttggctggccctgctgggagtttcgtctcctagcaggtacggaaagccatgagggatgctgctctcagcaacaattctgccttaacagagaaggcagaccagtcctcaggacctggagggaggtcatgttgtggacttcatagctggaaaagaacactggattttaggaacacggtcgcagaaagtttagactaagaagtagattcttctgggttggagcatatttccagaagagatgataaagttacaaggatgataagatggtaatagatgccttgatt

SEQ ID NO: 776 - DNA, 292 bp, Homo sapiens
  misc_feature (1)...(292): n = A,T,C or G
aattccgttgctgtcgattcattttgtataatcatgtatcctcttgtgtgctggtagagattttaatcctgatttttccataaaacatgagtattaagaaataattcctggtttggagaaactggataaatcacccttttaaggaagaaacactggaaatttctgctaacaccaagatattnaagagtggacatantaggtgcntnancncattaattganngaatgaangnttnnaaanactntcanancncntatnctnnnctaannctnttcnannnacnnnatttttt

SEQ ID NO: 777 - DNA, 299 bp, Homo sapiens
  misc_feature (1)...(299): n = A,T,C or G
aattccgttgctgtcggggaagtgggccaaaggaatcagctttaaaagccctaaatagtgacatgcccttatatattctgtcatcctctcaaggtagagggctgaaacctcattatgctcaacttatgaggctttttgttgtggttcctgatgctcctttgcagataatactaatgcctcaggttcagccaggcccaccaccatgtccggtattctacccagaaaaacaagaaatcacccttccacctgatggcctttgggttttgagattccttatgcntatgtgactganagaggac

SEQ ID NO: 778 - DNA, 293 bp, Homo sapiens
  misc_feature (1)...(293): n = A,T,C or G
aataccgttgctgtcgaagatgtaaagccacattgattcactcagccaaccagatcaatggctcatttgcactcaatttaattcatggaaagacgaaagcagagacagaacaagccaaaagtgagtttcccttttgacttattatcacttccacatntnnctggggagcagattgtncagagagagaaacngnnagcnantgtgtcaagngttancnncnggangaangcctcaaaacgacntaangnngnnnaagcagcnngaancagctcnctgtggtgaacncagaagtg

SEQ ID NO: 779 - DNA, 300 bp, Homo sapiens
  misc_feature (1)...(300): n = A,T,C or G
aattccgttgctgtcgcgaggctccatgatgcagcttacgtcggggacctccagaccctcaggagcctattgcaagaggagagctaccggagccgcatcaacgagaagtctgtttggtgctgngtctgnctctactgcatacnggtgcaantntcggntnnttttngnnnanggtngcttnngtnnnnttgtantttnnnttatntcttctnnnttnctctttaatatcntnttnntntngtnctnanttntttnnctnaanancncatntnantttncncnngtnttctntnctttctt

SEQ ID NO: 780 - DNA, 300 bp, Homo sapiens
aattccgttgctgtcggtttgttacagaaggagaaagtggcagttgaagcatttcagatttgctgccttctcctacctcctgaaaataggagaaagttacagctattgatgaggatgatggcaaggatttgcttaaacaaagagatgccacccctgtgtgatggctttggtacccgaacactgatggttcagacattttcccgttgcatcttgtgttccaaggatgaagtggacttggatgagttattagctgctagattggtaaccgtttctgatggacaattaccaggaaattctgaa

SEQ ID NO: 781 - DNA, 280 bp, Homo sapiens
  misc_feature (1)...(280): n = A,T,C or G
aattccgttgctgtcggcatatacagcaaattaaaggacccagaaagctggatccaatagtgacctgggtacaccaatcggaatattgaatttggggaagtcaagggctgggatcaagaggtggattggaactaatgccatgtaggatggtatgactaggcancantgtgttgttntctgtntatatantggtgtcctncctntcttgtntttntccttggtgntntnntncnactanatagtgactcctnagtcgggnncgctgcccctgttgaatttt

SEQ ID NO: 782 - DNA, 262 bp, Homo sapiens
  misc_feature (1)...(262): n = A,T,C or G
aattccgttgctgtcgttaagttgttggctcagtgtatgctggggacaaagaaaaactaacaagccgacctgcctttatgataaattctagtgtgcttacaagggatgacttcctgaggtgtgatctgnccaccttgaagaactccacanntgannaaggggagctgtgatancgagaattgggnnnnnncatnnggttnnancaangggnnntnangntnaaanatccctgantnaaatgnncnnnnnnnaaaaaattntc

SEQ ID NO: 783 - DNA, 299 bp, Homo sapiens
aattccgttgctgtcgctcaaacaaaaaagggacatttatgtgcagttgggacagcaaaccaagtcctggacgtaaaatcgaataaaagacacattcatatccaatagagaccacacctgtattcatatgggaacaatctggaatagtgatatcctcaaggggtaaaaaatatataaatatatatatatatgacaaaaggtatgaaatgcaaaaaagaaaaaaaaaggtgacagccgcagttgatgctgtgatggccgtgaagtgtcctgggcctcccgaggcctctgacaaataaaca

SEQ ID NO: 784 - DNA, 261 bp, Homo sapiens
  misc_feature (1)...(261): n = A,T,C or G
aattccgttgctgtcggatttgtgtcttgaccaggggccagatacagagaatgtccccatcatgtacatctgccatgggatgacgcctcagaacgtgtactacacgagcagtcagcagatccatgaggccattctgngccncacngnnnatgatnnnnacaccngatacancatgntgtagtgccctnctacagacantgncnatcagtgnccncttannngacnccaannnanttnccnnngtgtccctttannnacaag

SEQ ID NO: 785 - DNA, 300 bp, Homo sapiens
aattccgttgctgtcgcttgtttttcagacctcgaactatggagaacaggaattgaagcccaggtggatggtccaatgccagaccatggatcatcagcctgggacaccaaagtgccacactctcagagtgaggatgatttttaggaagtcagctctaccaccctccataccaggaagtgcaagcagactcatctcatgatcgagcagaatatgagaatccttttgaagttataagtctgtatggatttgtagcacatgttcatacaattagatgggaccaaatcccttaatttattaaga

SEQ ID NO: 786 - DNA, 262 bp, Homo sapiens
  misc_feature (1)...(262): n = A,T,C or G
aattcgttgctgtcggaagttattgctttccaggggtcactctggcttcgactccgtcgctctcaattcgtcaccaggaggaagacggagctggctgcccagcccaaaggcccatgaggggatgcagttatgggctctgtcgccgtggattgttattttgtgtcagtanntaatncntnttgngcnnacatgngnaagaancgntcnntggnaananctgttccnntcgaagattncnttgagctnnnaanccnttgnntnt

SEQ ID NO: 787 - DNA, 300 bp, Homo sapiens
aattccgttgctgtcgcaagggtcttctctttcactcaagctgccattctcctagccatttgtggcttgacaccccaagagctttattctctcttttcattgcttgagtccaccaagataccaagttaggtcaccttttattttaaatcagccccaacgagggtcccctccttttcacttttactcctctgctctaatccaggtcttcataaatttttgggcttttagctgatttccctgcctgcctctttcaaagccctttacccactgcggaatcatatttaccatgcaggactgcca

SEQ ID NO: 788 - DNA, 285 bp, Homo sapiens
  misc_feature (1)...(285): n = A,T,C or G
gacaacttcaaaaacaaatgagaagcccaaggaactgtgagcaattaaaagcaaaccgcgacaccctttgtctccaccacacatagtgtactttggaagcacaacgtccaggctggtaccgcagcgccatgcccattcctnttntnattcnttggacacttcaatttcntnnatannnttattanntnntgntttnattttanncnntctgntngctntttaaatttnnnntntcntannngttntnnanntnananatactntntnttnnactnntattttaca

SEQ ID NO: 789 - DNA, 266 bp, Homo sapiens
  misc_feature (1)...(266): n = A,T,C or G
gtccgacgcgcctggctaggagcgccgaccgcagggcctctacggaccttactagaaaaatgaaacctgatgaaactcctatgtttgacccaagtctactcaaagaagtggactggagtcagaatacagctacattgtctccagccatttccccaacacatcctggagaaggnttggcntngagnnctctnngaangnnnnnncnnngnntggganntnnactgtctnttncattngtnntntctttgantttctattnngncacg

SEQ ID NO: 790 - DNA, 300 bp, Homo sapiens
  misc_feature (1)...(300): n = A,T,C or G
cctggcantttnccananatctctaantncgaagctgtcgaaagaccacaagtttcagagcatggagacattcctgctgaatcgccttctcacctcctcggcaattgctcattctagggttgggcatcatagttggtcagtcttaattcccatgccaaaggacaaacaggtgtgacatttggatagatgaatactgggattggctctggagcatgtgttttgagttgaaccttgcagtcctttctctacgcccgtggattttgtggaaacactttgcaatctctttgtcttttttttttt

SEQ ID NO: 791 - DNA, 292 bp, Homo sapiens
  misc_feature (1)...(292): n = A,T,C or G
aattccgttgctgtcggccgctctctgtaagtgtttgcttgtgcaaaagggaatagtgccgtggaggtgtgtgtgtccatggcatccggagcgaggcgactgtcctgcgtgggtagccctaggacgcagagtgaggccnccanccanagtcagaccctttgnacctggnacatngtancattanacactttatatacctgagccnatnagccntgtncctcaancancanccctgacttggatatgnngaanaggacnantttggngcntcnnatactnntttngcttactc

SEQ ID NO: 792 - DNA, 300 bp, Homo sapiens
aattccgttgctgtcgctcactacctttggaccagccagggctgtttataagtgctaaagcccgaacaaaccaaagagttggggagaaaggcctaactaacagctgagtgattgtctaacagactgtcttttaggccagtgactctggcatagggcaggctgcatagccagcaacatcccttaccacaggtctagtgattcctctgggctcaaatgtggaggctacacacccactccttagcagaggttggcctggcacctgctggtgccccaagaactatggcatggttagaccctggc

SEQ ID NO: 793 - DNA, 300 bp, Homo sapiens
aattccgttgctgtcgtccattctttggacacccaaactcagcccccttaaagagtggaaacaaaacaagctgcactttgcagaggtggtaaatgaaaggactcttggcctaacttcaagagtcccctggggtttgaaggggcaaagtttgagtctggatggaacctgggctgaggtaccttaagcttccccccgcaacaccccagcctcagggattgcgggagttgtcagagatctgatggatccgaaaggggcagggccaggggattaggtttggggtcagaggttctgttttccagg

SEQ ID NO: 794 - DNA, 260 bp, Homo sapiens
  misc_feature (1)...(260): n = A,T,C or G
aattccgttgctgtcgcggggaagtggaagcgccgggccctgctgcgggggggaggtgtgggaggttttacnanatgggacttgggtatatttnttattaaantnattatnantnttntatnactatnttntnatnnnatatnttttantntnttccttacnnttnttnctnttaaatttntttnctatactntntttanntntgntatntatttttttntatnnttntanttatattaatntnttttacatatnttaaa

SEQ ID NO: 795 - DNA, 300 bp, Homo sapiens
aattccgttgctgtcgcctgtatatcccctaaactcctcacctatatcacaaaaacctgccaaggcagaatacattcccttgggaaaggagctttggcgggcaagcaggcatcgggtcccatctgacaccagcgtgatcgccacaggagccatctaggaaaggggaatggaaactgagatgctggcactttgggccctgccaatgagctaaagcagtgtataattaaggaattgcacaggcttccttccccaggacaaagcagcgcacagtcttcttggattactgtcctcttacagcaa

SEQ ID NO: 796 - DNA, 300 bp, Homo sapiens
aattccgttgctgtcgcttgggtataacctaacccaaagaaaagtggcatgtgctgaaactgagtgtcacagagctgtgaggttgggtctttgggattagcttcattttccagggtttgccctttgcccttcaaccaaaggacaaagtcatgttaacagctgctactaagtctatatgcccattcgttcataccacaaaacaggcatctgactcctctggtcaccatggaatcaaggcactgtcaagtggtggggggtccacaggcacagtgggcttcactctggaacaggattactggg

SEQ ID NO: 797 - DNA, 300 bp, Homo sapiens
aattccgttgctgtcggccaggggaggtcaaggctgcagtggactgagattgcaccactgcactccagcctggataacagagtaaaatcttgtctttaaaaaaaaaagtatgactcagcagatggaggagcctcccatttggtctttcctttccgtttggtttgtcttccaaatctcctccagcctgctgtgtattcctcagcaactcacttcaagcaccagcctgatcctgtagatgaaccctgcataactttctccgtcaacaaacacctgaggatctgctgtgtccccagtactagg

SEQ ID NO: 798 - DNA, 300 bp, Homo sapiens
aattccgttgctgtcgacttttcagaatgttcatgattttaatgagctgaaagatagagattcagaaacacgagttgatctgaaatttatgtacctggatcctccaagagatcatcacaccttagagattcagcagcaagccctgctaagagagcagcagaagaggctgaacagaataaaaatgcaggaaggtgccaaagttgacttagatgccatcccaagtgctaaagtacgagagcaaagaatgcccagagatgacactagtgatttcttgaaaaactcattattggaatctgatag

SEQ ID NO: 799 - DNA, 259 bp, Homo sapiens
  misc_feature (1)...(259): n = A,T,C or G
aattccgttgctgtcgggaaagtagcaaaagagtaggagatggggaaatagggatggggagagcaagccccgcatgtccatggcgagtcaggtggggagcacgggtggaagggccngctgtnnactgatngnctnncctgtgtnttcnagtgaganntcngtantcngggtgcactccntgctgtacnctcnnccctatnctgngnctactctgatnatgantcnacccttatnngnctnnctgctcntttgctctcng

SEQ ID NO: 800 - DNA, 300 bp, Homo sapiens
atttttagtttttcgagtacaccgtcccagaaagaaatacgctataacacccaccagcctgagggctgcattgctgtggaagcaggaatggatacccttatcatgcatctctgcgaagaaactgccccagagaatcagaagttcatcttgcaggaggatggatctttatttcacgaacagtccaagaaatgtgtccaggctgcgaggaaggagtcgagtgacagtttcgttccactcttacgagactgcaccaactcggatcatcagaaatggttcttcaaagagcgcatgttatgaagc

SEQ ID NO: 801 - DNA, 300 bp, Homo sapiens
aattccgttgctgtcggccaagggctccactccagtcccttgcctgtcaatcagaagatgctcagaggagaggcttctgcatcatcttcatcttgacattccaagagcagtaccgggtcagcatccacaaaagcacactgtaaaactgggaactgtgtcttacccttcctgagtgaaaagggaaagtttatgcctcagcctgaggcaggtgggccccttgccatgcacacctttgtcctgcagccagggatccacttggctgggctcaacccttccccgtcagggacgactgcacagaaa

SEQ ID NO: 802 - DNA, 300 bp, Homo sapiens
ggttcctgccggctgtattcgggccttggactggactgagaagctacggtgcggatccagctggggtggagaccatccatggaaaagaacccccctgatgatacgggccccgtgcacgtgcctttggggcatattgtggccaatgagaaatggcgcgggtcacagctggcgcaggagatgcaagatgctgcattctttatgtcaccgaagctgatttggtggcaggaaatggctacagaaagaggcttgttcgggttagaaattccaataatcttaaaggaattgtagtcgttgaaaaaa

SEQ ID NO: 803 - DNA, 300 bp, Homo sapiens
aattccgttgctgtcggctggtggcaccctcccctgggccggaagactgggaattcctgctaagtgtggcttctagagtgtttgtgtgtaccccgcttctgactgcctagggcgagtgggcatcctgtcatcatctccactgtcccaagcagtcactaggtggcggccgggccagctggaacccagcccatcctctcaggcagagcagggtggtccgggcacactgggcctgcctctccagcctcaggatgctcttgtttattctgggctcagaccctcctcttgtacgtctcatcacag

SEQ ID NO: 804 - DNA, 300 bp, Homo sapiens
aattccgttgctgtcgagaggtcagtgggtttgccgccgtgcatatcacgcccttcccccacgttccccctaccccaggacctccttgggacttacacggaggcccgaggtcagaaagcacttctggtccaagctgaggcaaggccgccccccatcccccaccccctgcctgcctcgccactcaacaccctggcgttccgaacaccctccatggccaaagtgaccactccctgtctgctgaagtgttttcatccccatgctcacatggacacccagccaccagcgtggtctcaggcacat

SEQ ID NO: 805 - DNA, 300 bp, Homo sapiens
aattccgttgctgtcggcccagggcctagcaatgtatcttcaggaaaacggcattgactgccccaaatgcaagttctcgtacgccctggcccgaggaggctgcatgcactttcactgtacccagtgccgccaccagttctgcagcggctgctacaatgccttttacgccaagaataaatgtccagagcctaactgcagggtgaaaaagtccctgcacggccaccaccctcgagactgcctcttctacctgcgggactggactgctctccggcttcagaagctgctacaggacaataacgt

SEQ ID NO: 806 - DNA, 300 bp, Homo sapiens
aattccgttgctgtcggcctgcccgaggtgcgggccgcgggtcagggccgcgcatggcatccccgacctggcccaaaagctccatttctatgaccgctgggctccggactacgaccagtgctgggattataggcatgagccactgtgcctggtcctgctccatgaatgtagagaagagaggcatttccaagaccaggtgaggaatccacatggggtgcaccctaaggcagaaaggagaggggctgagcatgagaacgaggaggcgctggctggctgcaggacaggaaatcatagaggtgg

SEQ ID NO: 807 - DNA, 300 bp, Homo sapiens
aattccgttgctgtcgctcccctcccaggagcctggggatgccaaacatccagaatgtgatgggacaagatgggggcaggggcctcacctccctgcagaggtccggccaggtctccttgtccctggacaatctcctgagcctctctgcttggtggagcaggcacctgtgtgcagaattcccactgtggccagcacgaggaagtcttttctagtgaaaatgtgtcttgtggtcaggaataattatcctttcccctgtagccaccaaggagggcaaatagagaaaggtaacctaattgaagg

SEQ ID NO: 808 - DNA, 300 bp, Homo sapiens
aattccgttgctgtcggaagaccgccagcctgatagccaacagttgtaaagcagtctctgttctaggatgtcccgacccagtggtgcatgagatcgcctatcagtacggaaaaaatgtaggaatagcttttcagctaatagatgatgtattggacttcacctcgcgttctgaccagatgggcaaaccaacatcagctgatctgaagctcgggttagccactggtcctgtcctgtttgcctgtcagcagttcccagaaatgaatgctatgatcatgcgacggttcagtttgcctggagatg

SEQ ID NO: 809 - DNA, 300 bp, Homo sapiens
aattccgttgctgtcgccctagtcttccattagctctttcactggaatttgagtatattgtacatgaaggttggttttcaatttgaacgtctagaaagatactcatttctaatacctatgcactgtagtttcaggtttacttgcagacaccctggtagggttaagaggaggatatttccaagttattttaaattgagtttacttttaactggggttcttgactctagtgtaattgctccaacaactacgtagaagtcaaaatgagtgactttagtgaagcttctgtactttacaatacat

SEQ ID NO: 810 - DNA, 300 bp, Homo sapiens
aattccgttgctgtcggaagggtgctgctattgggtctatggaagcttatctatcaaaggagcaaacgtccagaaaagtgtttataaagcaaatgtattgcctctgtttagagatttgcccagctgttccagttttaaacattaaaaaataaactcagttgccatggcaaaaatagaatgcacagcttacttataattttccatgcagtatagcataaggatttttgacttgaaacaaccaaagaactcctccttaacgagacagttcaaattcctgaattagtatttcttgactatcaa

SEQ ID NO: 811 - DNA, 300 bp, Homo sapiens
aattgttgctgtcgctctgtgtaagggcttgtctccctcccagtttttcttttgctccacgtcattttgtcaggctggttataagccggaggcagctttaaccagcccccagggatgattgtgaaggaggcccctccccttgtgaggagggggcactcctctccagcccctggtaccacagtcctcacgatggtgcagtgatttctagccaggcgtcaagatgcgctgctttccctctcctgctcatcccttgttggcagctccagttcaggccgtggagggacgtgatgctgggctgtg

SEQ ID NO: 812 - DNA, 300 bp, Homo sapiens
aattccgttgctgtcgcattaactttcagtttccccatgttacttttgtaacagggatttgagaccttaaactgttcatcaaagtaagccctaatagaaaggcagagcaataagagcacatgctgatgtaattctcctttgcaaggagaatttcatttagttccattgtcatatagaccagtgtcaccccttttccctgattcctactgataacaactatttttcagtgcctttgaagatactgacccttctacctgcccagctgtttttaaacagctggagcgtgatgatggtcataaa

SEQ ID NO: 813 - DNA, 300 bp, Homo sapiens
gctagattttcccatggtgccgttcctttgcagacagaggattcggagagccctaggagacaggcctgcaggaatgtgcttcattagctgcagtgcgctggtgctgcctaacagaacgcacactggctgtcactaggaagcgccatacggttgctatcacccaacatggtgaaagggtgatggatttcactgtgaatatgccaaggacacctctaaacttcccccatgtcagtcagatgaagttactactatatttcaccaccctgcaggtaactgaaactcaattaccgctgccgctca

SEQ ID NO: 814 - DNA, 300 bp, Homo sapiens
aattccgttgctgtcgcagggtggctgcacaattggcccctctatgctattgaacccccttaagggaggctccttgctagccctctggtttgtggtaatgtctgctgggacatattttacattttgcatgaagccatgttggagattcctttagctaaatataacatctggagaaagtagcctcctgttcacagcttaaaaacagactgactttgtctaggacgagagggaaaattgagcccgtttggtgctcctgacatctcctttcatgtaatgaaagctcagtctgtctaacctctg

SEQ ID NO: 815 - DNA, 300 bp, Homo sapiens
aattcgttgctgtcgcactgctttagcgagagagggtttacttaggaagaattgggatagaaattcccagctgagagaacttagctgtgggctcctcagctactgacttcttagctcttaatccccttagaatttcatctttctcgatgagcaggctctgcacccactctttttttgccccccgccctcatcctggagtgtgagggtgctcgcccgtactctcagctgcctctcagggactgcactgttcctcttcacccccaggttcctgctaagatcccacgggcgagggcttgctct

SEQ ID NO: 816 - DNA, 300 bp, Homo sapiens
aattccgttgctgtcggtgctgtcatcgagtcccaggtcacatcgtcacactcatcagccctctgcggccagtgtccccacctcctgccatgtttccctagtagcttggtctttatccagaactgtgaggctgctgtggggtgcagcgtccttaggagggtcctgctggagcagtggccctaagtgagtctggactgtgtgaggcaccccagccctccacggcaaggccggggcctgggggtgctggtgcctgtgtgcagcctgaaggctgccctcttgctgcttcagcgagtgggaagc

SEQ ID NO: 817 - DNA, 300 bp, Homo sapiens
aattccgttgctgtcggccgtctagtttggtgtgcaaggatgatgtttggagcaataagaacgtcgctttgtttttttccttttatagaaagagcaaggttcagggtaggcattagggcgggtgtaggtgtagaaggaactggattattggtttattgcatttagaatgtcagtctggtccttgcggtgtcaagatgaactcacgtgggatgttaattcacttgtaaaactgagggttatacatatgtgctcaggtattgggctgaacaggtgctttgggggtgcttttatgtgcccgac

SEQ ID NO: 818 - DNA, 300 bp, Homo sapiens
  misc_feature (1)...(300): n = A,T,C or G
aattccgttgctgtcgagccagttgaatttatggaatctaccaactgtttagggccctgatttgctgggcagtttttctgtattttataagtatcttcatgtatccctgttactgatagggatacatgctcttagaaaattcactattggctgggagtggtggctcatgcctgtaatcccagcacttggagaggctgaggttgcgccactacactccagcctgggtgacagagtgagactctgcctcaaaaaaaaaaaaaaanttcnntntttacaancctaaactntttaaaatccaaa

SEQ ID NO: 819 - DNA, 300 bp, Homo sapiens
aattccgttgctgtcgaaggttgcgtagctaataagtggcagaactgacatgcaaaaccagtctgtctgcccccacagatgcatgttctttaccatcacgtaggtcaggccaggatgtcaaggagagcaaccccgaactagtcctggtgatttagactagagcgtctttcactgctgtgattccttcattggcactttcttccagttgtacagtgtctgtctttgcttggtctttgcttgttctacccttagtttagcagatatccctctctccatgaacaaggtgagtgagctcttttt

SEQ ID NO: 820 - DNA, 300 bp, Homo sapiens
aattccgttgctgtcgccaaacaaacattgcagggttgatcctagtcttgaaagttcgggcctttcctcttggcctgtttctggaggaaatgctcatgaggtgggtgagaggcggatgacatcctgtcgctctggcctcaccctggggatgccacatgacagcaccgcagcattttcaataggtgacccacctgcgaggaggaaggaaaaatgtgcccaaggccattatggagaacaaacacctatgcagttggagaatgctgaagacacccaagggtgttgtcctctccctcctgagag

SEQ ID NO: 821 - DNA, 300 bp, Homo sapiens
aattccgttgctgtcggcactggtggcaagaggctgctgatccccgttgtgcctggtgtggacagcctcaactcggccatggcggcaagcatcctgcttttcgaagggaaaagacagctgcgggggaggtctgggaagttgagcagggacaggagttaccactgaggacgcagaagtgacttctgcttgaggacgtctgcagctcctcctacaccagcacactggtgggaggctggcggagtcagtgactatggcccacgttcaggaggaaggtgtgatgccgtcatacagttacaggaa

SEQ ID NO: 822 - DNA, 285 bp, Homo sapiens
  misc_feature (1)...(285): n = A,T,C or G
aattccgttgctgtcgctgacggcgcttttgtctccgggtccagaggcctttcagaaggagaaggcagctctgtttctctgcagaggagtagggtcctttcagccatgaagcatgtgttgaacctctacctgttaggtgtggtactgaccctactctccatcttcgttagagtgatggantncctacagggcttactagaganccnatcnccngngacctnntggancancnnaanccnnntancgaacnnagagcncaccaanaggcctnaccaccatccatcc

SEQ ID NO: 823 - DNA, 300 bp, Homo sapiens
aattccgttgctgtcgcaaatctttgccacttctaaagcccaaaaattactattccggatcatagattggttactgctgccacatgcagtattacagcaagagaaggaactgcctgcacctatgttgtcagcaattcagaaaagtcttcctttgtatctccagggcatgtgtatcgtgtgttgtcaatctcaaaatccgaatgcctatttgaatcaattgctagggaatgttattgagcagtatattgggcgatttcttccagcttcaccatatgtttcagatcttggacaacatcctgt

SEQ ID NO: 824 - DNA, 300 bp, Homo sapiens
aattccgttgctgtcggaaaagagaacaacatgagattaaaaatgagactaaaaggagtagcactgtagatgggttaaggaaaagacccctcatcgtatttgatggaagttcaacaagtacaagcataaaagtgaaaaagacagagaatggagataatgatcgactgaagcctcccccgcaggcaagctttaccagtaatgcctttagaaaattatcaaattcctcttcgagtgtttcacccctaattttgtcttccaatttgcctgtgaacaataaaacggaacacaataataatgacg

SEQ ID NO: 825 - DNA, 300 bp, Homo sapiens
aattccgttgctgtcgcctaaactcggagcagtgggaccctgaagatgtgaacctcgaaggcagcaaagaaaatgtggagctactgggatcccaggtgcaccaggactctgtgaggacagcacacctgagtgatgatgattaacaccttctggagccagctcatcagctcagagcccagggtcaggagttcgttcagtaacgcagcgggaatcaatctgcactgacaccgcggcaggaactgaagctgccctggcaagtgaggaaccaggagccgtcactgagtgtggctgggctacatc

SEQ ID NO: 826 - DNA, 300 bp, Homo sapiens
cccacactcgagcccacccggccggccagctttagaggaggggaggagcagggcgagttcacattattccttttccatcggaagtggcgctcgtgcattcaactcgttcccgctcatggaacccctctttaaaaagacgcagggcacctgtgagcgcaggagcgagcctaaggccacccagcggcagcgcccgtgtcctgggcactcagcgtgctgggcagagcaggtgcgatggccccagtcctagcagccctcgcccatgtcctgtgcccttacatggctcccggactgtgcagggag

SEQ ID NO: 827 - DNA, 267 bp, Homo sapiens
  misc_feature (1)...(267): n = A,T,C or G
aattccgttgctgtcggtttttgttttaagagagtataaggtgtctcatttgagtctttttcttacctagccccctcttatcagtaaaacaaaggacttgccatggttcacagcaatgtgctacgatccaagatatcagccaaggagcccacttaggggagaactaggtgtccagatttttgtatgtgttgnttttcttgggggatggggtggggtttcnnntccnntattnnnantgtttnncnnnnanctntgncnctntacanc

SEQ ID NO: 828 - DNA, 300 bp, Homo sapiens
aattccgttgctgtcgcattttcaacaaaacatccctggagtcagattttgagttggggtgggctaatcagggagtcggggctctctgcgtgatgtcagttctatggctaactggtttttctaaaccagccagctgcctatcaaaacagtacaacttttctaggaaatgcaattggcaaagacacttacgatgctgagaagtacacaaggtgaaactgctccagtttttctcatagcagggtcagcaggaaagcaagtggtgcccctggtcccatctcacacaggtgagactgcaccgag

SEQ ID NO: 829 - DNA, 300 bp, Homo sapiens
aattccgttgctgtcgggttgttgaaagtccagatttttccaaggatgaggactacttaggaaaggttggaatgttaaatggaggccgccgaattgactacgttctccaagaaaaaccaatagagagttttaatgaataccttttcgctcttcagagtcacttatgctattgggaatctgaagatactgctctgttactacttaaagaaatttatcgaacaatgaacattagtccagaacagccccagcattgatcaaacttcagttttactgtactttcttgtctgcacagaaagtccc

SEQ ID NO: 830 - DNA, 298 bp, Homo sapiens
  misc_feature (1)...(298): n = A,T,C or G
aattccgttgctgtcggtccatcttcctcttctctgcccctgcatttccatcccaggaggaccactgggcacaaggaacatcagaaaccagggagcagtgtgcattgggattccttccagacgctgagagctgagaagtcgtccccctttcataaccttgctcagactcaggaggttgaggcagaagaatcgcttgaacccaggaggcagaggttgcagtgaaccgagatggcgccaactgcactccagcctggtgacagagcgagactccgtctcaaaaaaaaaaancaaaccaaaa

SEQ ID NO: 831 - DNA, 292 bp, Homo sapiens
  misc_feature (1)...(292): n = A,T,C or G
aattccgttgctgtcggcagctagtaatttgccttctggattcctggcacctgtgtttgctctgtttgtaccattttactgctccataccaagagtccaagtggcacaaattctgggtccgttgtccatcacaaacaagacattgatttatatattgggactgcagcttttcacctctggttcctacatctggattgtagccataagtggacttatgtccgntctntncnacgacnacttgatgaccaagtntgtcatnatgngaatgaataactactanagactaaactat

SEQ ID NO: 832 - DNA, 196 bp, Homo sapiens
aattccgttgctgtcggtttatatccaggatccgtgcctttccaccgggtgtggtgggcccagaggcagccaaggagtgtgctcttctgtccagatgagccttggagcccagaatggaaaacaaatcaagcatcggccctaagaggaactgaaagcagccacccaactctttcccagggccctcattctgaataga

SEQ ID NO: 833 - DNA, 300 bp, Homo sapiens
aattccgttgctgtcgatcccacgtatatttttcacccaagatgtcggattactcttcccaatgatgagacgcgtgtgaatgcaacgatggaagatgtgaatgactggctgactgaactctatggcgatcagcctccattttctgagccgaaattccctacggagtgcttctttctcaccctgcatgctcaccacctctctattctgcctagttgccgtcgctatatccgcagactccgggctatccgggagctcaatagaactgtagaagatttgaaaaataatgaaagccaatggaaa

SEQ ID NO: 834 - DNA, 300 bp, Homo sapiens
aattccgttgctgtcgatttttcattatgtctacggaggagtgtctctgttatatcagtaggaaatcaaggtggctttttcagagactgtgttggttcctttcaaatatttgaaacactgacagaaggagacattttagatttcctcaaagtttacactgcccagttttggggggaggcatgcctagtttctttgaaactggctatgttttccttaatacctgatttgcctttctctgtaatccttaaaataaaatttgttaaaagtgttcttcattatggaaacaatatatatgtggta

SEQ ID NO: 835 - DNA, 300 bp, Homo sapiens
aattccgttgctgtcgtttaatacttttttttgctaagtgctgctgggaaacacatggaggagaacaaaacccgacaagcctggtgctgctcttactgtatctgtggggtggggaatggggaagttctgaaaatttacaggtgtgtctcagactaaagggtttcaaaacactgtgctgaagcagtgcgtgttgaggtagaaggcacaggagtgttcctgtggttgggagagatatcctgtgtccagaatttgaggcaggagatagaggttttgctggtgggattgtggtgagactcctag

SEQ ID NO: 836 - DNA, 300 bp, Homo sapiens
gccccaaggagtgctagctgagggtggttgctggggtggtcctcatggacagtgaggtgtgcaagggtgcactgagggtggtgggaggggatcacctgggttccaggccatccttgctgagcatctttgagcctgccttccggtgggagcagaaaaggccagaccctgctgagttagaggctgctgggatccactgtttccacacagcgggaaggctgctgggaacaggtggcagagaagtgccatgtttgcgttgagccttgcagctcttccagctggggactggtgcttgctgaaacc

SEQ ID NO: 837 - DNA, 300 bp, Homo sapiens
aattccgttgctgtcggagatggcggagttggacatcgggcagcactgccaggtggagcattgccggcagcgagattttcttccatttgtgtgtgatgattgttcaggaatattttggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaaagcctcga

SEQ ID NO: 838 - DNA, 300 bp, Homo sapiens
aattccgttgctgtcgattttgaggaggatggatgaacagagaccgaacgtcgaggaacagatgtggtcaccgaagtccccacacgctggctctccacacccctcctgttccagaaagcatgtccgaaagcagtccaggagattattaaggggtcgccatgaatccactttggttttaaaaccattcccgaatgtcctagtggattgtgttgtgctgcctaagctgccggctgcaggagccagagaagtgacccccgcgggagcagcggcaggtggatctccacggtggctcgctttgtt

SEQ ID NO: 839 - DNA, 300 bp, Homo sapiens
aattccgttgctgtcgctgcgatcctttctgtagcagtgattctaaagtggcgtttgctgtgtgcttgagagtaacactgcacgctgcaggggctgttgcagcagtcagtcccaggaagccacagcgcttgtaggatctgctaggaccctgcagctgtgctgccgccacctctgctccagagtgtcccagccaaccctcggaagatgggattgccagtcagccctgcctcaccatgcctgcaggaggctgtccagggagcaggtctgtgtgcccatcagcaggttcccatggctgtcact

SEQ ID NO: 840 - DNA, 300 bp, Homo sapiens
aattccgttgctgtcgcacacctcctgccccactgccctgcttggactctgactcccactcactctgggaagcctcctcctacccaacatggacgatctcctcatgcctgcttgggcactggcctccattctcgggggccctaatgcttagacatgctcctcaccctctgcagctctgacaccctgtgttgggatgccctcacatgggtaccccctcattctgcctgtgcttcaacaccccaggcccagctgtgctgtgcgtgaatacccttccaccccactcaggttctgacttcccac

SEQ ID NO: 841 - DNA, 300 bp, Homo sapiens
aattccgttgctgtcgggatagacaaggtaaagccgtatctcccaatgatcatagctcctttgtttcgggaactcaacagcacctattcagagcaagatcctttgctgaagaatctatcccaggaaatcatagaattactcaaaaagctggttgggcttgagagcttctcattagcctttgcctctgtacagaaacaggctaatgagaaaagggcactccggaaaaagaggaaggccctggagtttgtaactaatcctgatattgctgccaagaaaaaaatgaagaaacacaaaaataaa

SEQ ID NO: 842 - DNA, 300 bp, Homo sapiens
aattccgttctgtcgggttcccctgatccccagccccttgtcatcagcagtgcccctgatcctacctcaggccccttcaggcccatcctatgccatctacctgcagcccactcaagcccaccaaagtgtgacgccaccccaaggcctgagcccaacggtgtgcaccacccactcttctaaagctactggctcaaaagactccacagatgccaccactgagaaggcagccaatgatacctcaaaggccagtgcctctaccaggcctggaagcttgctgccagcaccagagaggcaaggggc

SEQ ID NO: 843 - DNA, 300 bp, Homo sapiens
aattccgttgctgtcggctcagccagtggaaatcccgccaagcagaggcagccagtatggggggccaggctggccttcgtacggggaggacgaagcggggcgaagagaggccacacacatgctcggacatcaagagtattcttcttcaccgctatttcaggtgccaaggacttcaggcagggagccctcagctccttccgggaacctcccccaccggggactgcagggccctgggctgggttaccccaccagctccacggaagacctccagcctggccactcctcggcctctctcatcaa

SEQ ID NO: 844 - DNA, 300 bp, Homo sapiens
aattccgttgctgtcggtcttggccggcgctgacgcagccatggcggaggcggctttggaagccgtgcggagcgagttacgagaattcccggccgctgcaaggggtgggagctgccctggggtcaggtgtgagcagtgattactggcatctgggcatgggctgagtgtccattcctctagagccacagtgggctccacagaggtgagtgtggccgtgaccccagatggttacgcggatgccgtgagaggggatcgcttcatgatgccagctgagcgccgcctgcccctgagcttcgtgct

SEQ ID NO: 845 - DNA, 300 bp, Homo sapiens
aattccgttgctgtcgatcagtattgtggcccaggtggaccagaccggctccaagtccagtaacctcctggatctgaaaaaccccttctttagatacacgggcacaacgccctcacccccacccggctcccactacacatctccctcggaaaacatgtggaacacgggcagcacctacaacctcagcagcgggatggccgtggcagggatgccgaccgcctatgacttgagcagtgttattgcagtggctccagcgtgggccacaacaacctgattcctttagggtcctccggcgcccag

SEQ ID NO: 846 - DNA, 300 bp, Homo sapiens
aattccgttgctgtcgggtgcagctgccgccaccgccgcttctgcaaggtctcagggacgggctgcagccatgtcctattgccggcaggaagggaaggatcgaatcatatttgtaaccaaagaagatcatgaaactccaagcagtgcagaattggtggctgatgaccccaacgatccatacgaggagcatggattgatactgccaaatggaaacattaactggaactgcccatgccttgggggaatggccagcggtccctgtggagaacagtttaagtcagccttttcctgcttccacta

SEQ ID NO: 847 - DNA, 300 bp, Homo sapiens
aattccgttgctgtcgcaaaatgtaagctgtgctcctctcatttttatttttatttttttgggagagaatatttcaaatgaacacgtgcaccccatcatcactggaggcaaatttcagcatagatctgtaggatttttagaagaccgtgggccattgccttcatgccgtggtaagtaccacatctacaattttggtaaccgaactggtgctttagtaatgtggatttttttcttttttaaaagagatgtagcagaataattcttccagtgcaacaaaatcaattttttgctaaacgactc

SEQ ID NO: 848 - DNA, 300 bp, Homo sapiens
aattccgttgctgtcggaaaatatctaaattttgcacaggagagcaattagagaggcttaaacaggaaggaagtcttctaattccttaaaagcattatctcatatttgaagagttcaagtttgatgcaacataaactgataaagtttgaaataaaaagagacaggttggtaggaaagaccattcatatcctatccccaaactggcttaagtccactcccactgcccccagctaccacctttttactttattctacctgctatttctttggccaccggaataataagcctgatgtaaattc

SEQ ID NO: 849 - DNA, 300 bp, Homo sapiens
gaaagaactccctggctgtagctcctatgtaggtttaggttgagactctggattccacaatttttaaaggttaccatctgaggtttctgatcatagtctacttttgaagcagctgctgctatttctttattccattgaacaccctggaattgacataattttatctatcagcatttctccccttttagtttatttaataattaacccggtctccagggcagttttcatatgaccatgtgtatattcactgctcacgaataagtttaatgttagattaccaaatttaatatagttacagaa

SEQ ID NO: 850 - DNA, 300 bp, Homo sapiens
  misc_feature (1)...(300): n = A,T,C or G
aattccgttgctgtcgagaactttcatttctaagtacgcttactggcntcaatataagaaatcactccaggcagacagaagacctaacaagcactgagatgacagaaaagagaattagaaaagttctacagagacacagattatcaggaaattgccacatggttacatttcaacttgaatttcagattctggaaattcaaaataaggagagattatcttctgctgttactgacctcaacataataatggagcccacagaatgctcagaattaagtgaatttgtgtctagagcagaagaga

SEQ ID NO: 851 - DNA, 300 bp, Homo sapiens
aattccgttgctgtcgcaggtgactgccaacagccagcccaatgtcgaatccagaaatgcaccacggacttcgtgtccctgacttctcacctgaactctgccgttgacggctttgactctgagttttgcaaggccttgcgtgcctatgctggctgcacccagcgaacttcaaaagcctgccgtggcaacctggtataccattctgccgtgttgggtatcagtgacctcatgagccagaggaattgttccaaggatggacccacatcctctaccaaccccgaagtgacccatgatccttgc

SEQ ID NO: 852 - DNA, 300 bp, Homo sapiens
aattccgatgctgacgagtttgcatctaaataatgcctatgagttgtgtgaagctcttggctttttttccaacgttactttggaactaatgagggtggatgttcattgtagtttatttatttggttctttacatggaggaatttaaaaaatcaaatttttctcttcacctttatgacttgacatttccttgatctgttggaggctaaaagtaggtataaatgatattgaatgttgggtatagtgatactctgccatagtccttactgcatgaagagaacgagaagtcacacaagttcacc

SEQ ID NO: 853 - DNA, 300 bp, Homo sapiens
aattccgttgctgtcgaacttgtccaagttccagatgaccaacaaagacagctatagacactctaactctgtgccaattacccaaggccttcagggccctgggacctattccatgatagtggtaccctaactgaacccatttcagccactcagattgatagggtggaaaagacagggcaggtggtagcagctgtgaagaaaagaggaaagcagaagggtggcctataatctacaggcatgtagagaggactacataggcctctgttctttgcctcaggagcccccttcctgtcccttgga

SEQ ID NO: 854 - DNA, 268 bp, Homo sapiens
  misc_feature (1)...(268): n = A,T,C or G
aattccgttgctgtcgggtgcagctgccgccaccgccgcttctgcaaggtctcagggacgggctgcagccatgtcctattgccggcaggaagggaaggatcgaatcatatttgtaaccaaagaagatcatgaaactccaagcagngcagaatnggnggntgangaccccaangatncatacnangancacgnctagtnanagtcananggnnannnancnagnaacanncnngccangngnaananannncgnnnnnnnnnnnaanag

SEQ ID NO: 855 - DNA, 300 bp, Homo sapiens
aattccgttgctgtcgaaacatctggccaacctccaaagtattttcatttatcacattctgcctctgtgtccaactgtccttgactgttcgtggtaatgggaaactcactactctggaggtagctattccattgttggaaagcgctgagatttaaaagctcctcatgttgaattgaaatcccatttcctgaggtttgtgcaaccagtgtatgatatttctagaggctgcctaaaagagtccagtttagacctgttaccttagaaggccccctccaaagttagttgatctgttcagaaaag

SEQ ID NO: 856 - DNA, 300 bp, Homo sapiens
aattccgttgctgtcgctgcacaggacacttatgccaccctcttgccagatgcctttgaagaaagagtcagactggtccaccctcccccagcccctggggctccttgagcctctctccagccttggcaggaggaggaaaagcagcacctccctcagacagctggaaaggccctcttccttcccagctcagtgggtccggccaagggtcaccagacgggtatttgtccccacctccctaccaaccccaagaacacactccacacccctcttcgctgctgcggtgtgaagcttcagcctaac

SEQ ID NO: 857 - DNA, 300 bp, Homo sapiens
aattccgttgctgtcgggagaaccaggaccccagagaggtggggccactgaggctggtgcagttgcgctcactcatcagcatggcccggaggctggggggcatcgggcataccccagcaggcccctatgacggtgtgtgaccaggccagcccagtgacctttctcctgctgcacttggagggaggggacatacacacagtctcccatctctcctcccctccccctggggtggcccaccgcatgggtacagggggttccaggaatccaaatccagcatggcttggaggagctctgttggtg

SEQ ID NO: 858 - DNA, 300 bp, Homo sapiens
aattccgttgctgtcgctcacgccccctaactcgcagggctttgccccccactacgacgacatcgaggccttcgtgctgcagctggaaggtaggaaactctggcgtgtataccgaccccgagccccaaccgaggaactggctctgacatccagccccaacttcagtcaggacgacctcggtgagccggtgctgcagaccgtgctggaacctggagatttgctgtattttcctcggggcttcattcaccaagctgaatgccaggatggagtccactctctgcacctcaccttgtccacgta

SEQ ID NO: 859 - DNA, 276 bp, Homo sapiens
aattccgttgctgtcgctcttaatttctttctgggtagtaaaaagaacatgtttcattctttgcataaatacttgactctaagcattgacctttgaaaacgcttgtattaacaatttttattaagaaagtgcactctatataacatcttcttgcattacgatagctcattagccaatacacatgcagctatgtaagccacaacagcagacgtcctatccttttgcttttgtttttaagggatcaaaatatttcaagggataccatgaggaagggtg

SEQ ID NO: 860 - DNA, 300 bp, Homo sapiens
aattccgttgctgtcggttgatggccaggaaagaagccagcacagggttaaagtaactcctggcattgcccaccagggggctggtgcacctgctgacctcagggtcacagttgagtcatttgccagttgacggagcaagtttgaccttggttctgttgctgaagcaaatttggaacttttctgtctcagtgtgatccactaacccacaggatcatttggaaccttgaatagctctgcttggacaatggggttggggaatagggttgtctttcctatgaaaatgccatctgtagaccttgt

SEQ ID NO: 861 - DNA, 300 bp, Homo sapiens
aattccgttgctgtcggggttgcccacccatgggagagctgctctgtattttcagcagaatagggtgtgttagtgtcagagcctttataagaaacaggccagtaacccagcccccttccatggaattcatctcattcgttgtgacacatgatttcctcccaacccagtttggctttctaaatttagtcctccataatgggaagtagagatctttagttaatggattagcaagtttttgcagttctgctatggtggtaaagggggagtaggagaataacattaagtggcaatagtgcattt

SEQ ID NO: 862 - DNA, 296 bp, Homo sapiens
  misc_feature (1)...(296): n = A,T,C or G
aattccgttgctgtcggagctttccattacatgagctgtctcaaagcccttaagaactaggtttagaaggtgcagagaccagggcaacttcagggatccaggtagcaggaaggaatcggtagcctctaaacctagttcttaagagctttccattacatgagctgtctcaaagccctccaataaattctcagtgtaagcttcaaaaaaaaaaaaaaaaaaaattncnngggncngtttttnncnaaaanccaanctnnanaaaanccttngagnatttggnnnaacccnnacttaaa

SEQ ID NO: 863 - DNA, 300 bp, Homo sapiens
aattccgttgctgtcggttgagaagtgctggcttattagagactctggctgaaggtcatgtgcgaactcaggaaactgctaatcacgggtcgtgtttttcagcccctgtcttcaggaaggcttaactctaagggagggttgttttgtgtcatctccagagctctcatttctcctgtgtggcttggtgccgaagctcattcgtcccctcgctgtctgttcggcccttgtcctacctcccctttctctttccacgcttttgtgtaaagtagccctctttcaagctgctcctctgcctttgaa

SEQ ID NO: 864 - DNA, 300 bp, Homo sapiens
aatccgttgctgtcgaatctgtaaacctttatgacattaggaactaagaaacttagtcccttcgttagggggataatgaaatgtatttagtgtttgtgaaacatagatggtatgtatttggacaattctgtaactttgctttttttatttttatttttccatagcttattggggaacaggtggtgtttggttacatgattaagttctttagtggtgatttgtgggattttggtggacccatcacccaagcagtgtacactgcaccctatttgtaatcttttatccctcgcccccctccca

SEQ ID NO: 865 - DNA, 286 bp, Homo sapiens
  misc_feature (1)...(286): n = A,T,C or G
aattccgttgctgtcgaataaagtccatctctcaatacttatactttctaaattcatctcagaatattagcagccatattccacagttcctataatttttactgggggggatttgtgataggaaagtccttgggaaacatttccaatctttcaaaatattatcgcggatcttaagaagcatcggaacttgnatgttgnaanggtgcatgntanancttncnccntctnctacgacccgccnttntnncgnncccnccanntngacgngccccccnncccccccctc

SEQ ID NO: 866 - DNA, 292 bp, Homo sapiens
aattccgttgctgtcgggttttgctaatctggattcctgtggaagggcctcctctctctgctcgtgttttatagcttggcaactctagtgctagttctgcaatattcgaatttgagtagccagaagaatttgctgccagggtggccttgcccttgactttgaaatgaactcacccgagacttcagcttgatgcctcctttggctaatgctgggttctgggctttggccgccgcctgcctgtccatcacaaggggccatgctctccaatcaggacagaagttttaacatttta

SEQ ID NO: 867 - DNA, 300 bp, Homo sapiens
aattccgttgctgtcggggcagcccgggttaaaggcacactcactcaaggccggctctcatttagtggcaccgcaggttaaatgctgctcccaggccttgggtcccagtgaccaggaaagttttgaaaatgagaacatgtgttgaccctaggactaggacaacagcgcccttgattttgcggaagtcttccctggaagttgggcgtgcttgatattgagacgctgcactttgtgtttcttgacggctttgctgcaaattctcacacaccttgcgcttgagtaaaaccccaaggattccag

SEQ ID NO: 868 - DNA, 300 bp, Homo sapiens
aattccgttgctgtcggtctgctgcacgtgttcgcgtgcgcctgccccggctgtagcaccggcggtgcgcgcagctggaaggtgttccgctcccagtgcctgcaggtgccagagagagaggcgcaggacgctcagaaacagggaaacagccttgcagctgaggactggtgtgaaggtgctgatgactggggaagtgatactgaggaggggccttcaccacagtttaccttggattttgggaatgatgccagcagtgccaaagacgtagactggactgctcggctccaagacctccgcctg

SEQ ID NO: 869 - DNA, 300 bp, Homo sapiens
aattccgttgctgtcgcagacaccttctcctatggtgggcatgaagacttttcaaaaatgattgatgaagctgagcccctgggctacccagtcgtggtgaagagcacacgaggccaccggggaaaagctgtttttctggcaagagataaacatcacctctctgacatctgccatctgatccgccacgatgtgccctacctgttccagaagtacgtgaaggagtcccatggaaaggacatccgggtggtggtggtagggggccaggtcataggctctatgcttcgctgctccactgatgga

SEQ ID NO: 870 - DNA, 300 bp, Homo sapiens
aattccgttgctgtcgaaactgtgggcatttatctgtgagctcgggccccacggagggttaaagctcttcttggaatgcctgaacaatgacactgaagagtccaagcaactcttggccatgctgatgctgttctgtgactgttcgcggcacctcatcacaatccttgatgacattgaagtttatgaagaacagatttcattcaaactggaagagctggtcactatctcctctttcctgaattcttttgtgtttaagatgatctgggatggaattgtagagaacgccaagggtgagacctt

SEQ ID NO: 871 - DNA, 300 bp, Homo sapiens
aattccgttgctgtcgctggcatttggacgctacattctggaaccattttttattcaatgtgaaatccctgaacttgcgatcaagctcattacagctgtgggcataactgtagtgatggtcctaaatagcatgagtgtcagctggagcgcccggatccagattttcttaaccttttgcaagctcacagcaattctgataattatagtccctggagttatgcagctaattaaaggtcaaacgcagaactttaaagacgccttttcaggaagagattcaagtattacgcggttgccactggc

SEQ ID NO: 872 - DNA, 297 bp, Homo sapiens
  misc_feature (1)...(297): n = A,T,C or G
gtggtggtacacgcctgtaatcctaagtactcgggagactaaggcaggaaaatcgcttgaacccagaaggcggagtttgcagtgagcggagatcacaccactgcactccaccctaggcaacagagcgagactgtctcaaaaaaaaaaaanttaccntnnnttttttaggncntttcnaaataaaanggggatttttttttcntgtntaaaaatntaanctanttgttncnttannaaaatngnatngggngggtnagnanatgngnncttgnaacagtntccnnggntcctttatcc

SEQ ID NO: 873 - DNA, 300 bp, Homo sapiens
aattccgttgctgtcggaaccatagactcaatccttcctaaaagctcaaggctttctggcttggtaattttgtggggaagcacttgcaggaaaaacactttgaaatatgaagaaggaaatgtgattccggtggtttctttataggccctaaatcagtacaggaagaaataggacaagaaccagagaagattaactttctgaaactttacaaacagcctaattcccaagtagagaaaagtatattttaaagaatgaatactgggggaggaaatgaaggaaggtgaattaagccttcacagt

SEQ ID NO: 874 - DNA, 300 bp, Homo sapiens
aattccgttgctgtcggttgtaatcaagcttttccacagttcttgaaaagtactatgtttcaaatttcaggaacaccagcgttagctgtaaaagttgcagcaatttattggctagtcatagaaaatttttgaacttttaactgtattttaattgatgtttattaaaaacactttgctatcagatatttggcataaatctgtactcttcattatagttttggggggagagaagattcagtcagaaaacttattcaaagtacctaagtattataaaggagtcaaaaaggtacaaagagaaaa

SEQ ID NO: 875 - DNA, 300 bp, Homo sapiens
aattccgttgctgtcgcaactgcctttttaagaaatttcacttcttgcctaattttctttcccttctgctatagaaatattatgggctggatacaaaatggggtgacatcgagcagtggatggtaggccttgaatataattttgtttttactcttccctccccacttgaatacagtgttgagacttaaatggtttataatgtaattcttacgcagtttaactatgtagatagattcctattgcaccataatttaatactgagagattttcttccggggatttctgcatctggtctctgtt

SEQ ID NO: 876 - DNA, 300 bp, Homo sapiens
aattccgttgctgtcggtgggatggctccccctatgaaagttgtccagtgagcagggtcaaggtttaggtttggggtacggacatgagtgcaggagccttactctcctgtgtgttgtcagggatggataaaggggatgaagttggaggggtttagtgaatggttgggacagcaaatttcagagaagagcatttggaaataattttctcaaatatatatttttaaaatccatatttgatttttttccctcagggattcccaagcatagtagagctaaaatgaattaatttgggtaaaagta

SEQ ID NO: 877 - DNA, 279 bp, Homo sapiens
  misc_feature (1)...(279): n = A,T,C or G
agctaacaaagtgagttcacagcttccaagaccccaggctttccaggctaataaagagctgaggttataggctctccttatcaaacgctctttggcagctgccataaccattccaagtctagtcctagaatagaaatgacgcggtttcaggagctgacagatggaactttaagccttccttcctgccacatctgaagttcttttttaaannnataganaaccatgacgataaacactccttgaatgccctgnngaanagtgtacttctcanaattcact

SEQ ID NO: 878 - DNA, 300 bp, Homo sapiens
aattccgttgctgtcggtcttctcaacctcctattgttgttataaaatctctgtgaaaggcagcagcctcctctgccttccatattaaccagcactttccctgtccagaagttattccatcttacggatattgagaagataaatggaagtgattagaatgtactttccaaacataaaacattgtactgtaggagtttgtcaaaggggattaatactaccacatatctgtagaagaactttatgaagaccctgtgtatctctcaaccttaatgactaagattgtagatatgatagaaatct

SEQ ID NO: 879 - DNA, 274 bp, Homo sapiens
  misc_feature (1)...(274): n = A,T,C or G
aattccgttgctgtcgggccaacaaggcttccagctggatgtgtgtgtagcatgtaccttattatttttgttactgacggttaacagtggtgtgacatccagagagcagctgggctgctcccgccccagcccggcccagggtgaaggaagaggcacgtgctcctcagagcagccggagggaggggggaggtgtgggagggtctgnccggnatgttggacttcncggtcaatgtcnttttgtnntncctggaattngcttgnannggtacttcct

SEQ ID NO: 880 - DNA, 300 bp, Homo sapiens
aattccgttgctgtcgcaaactttcttttgtttcaccagtgggaaggaaaaaataaatgtgaaccaaagcaaactccctacatttagctcatggggttgattccttcgcttcttgcagtggtcttggccttttgtttgcaggccaggagagctattggtgatacccacctctgggctaggatgtgatgggaggtgggatgtaggggcccagggagaaagggttgcagccagcggtcaggctgggagcagagacctccaggcgggtccctggtgttctgggcagtcacgcccaactgccaa

SEQ ID NO: 881 - DNA, 262 bp, Homo sapiens
  misc_feature (1)...(262): n = A,T,C or G
aattccgttgctgtcgcatttatgttctattgtgcgcactggcaaacgtatgtttctggaacattgcgatttggaataattgatgtgactgaagtgcaaatcttcataataatcatgcatttgctggcnncgattnnaggncnantttnctnnnccanatnatttcagtnnttgntantntntnnnangnattnnntgnatntnantttagtgnntaanttnnnnttttntttgcnnntttnaatntnnntnttntttcctt

SEQ ID NO: 882 - DNA, 300 bp, Homo sapiens
cttctgtagatactgaagaaacaattgaaccttatacaactgaaaagatgagtcgagttcctggaggatatttggctttgacagagtgctttgaaattatgacagtagatttcaacaaccttcaggtgtttactacaatctggaggcaagatctttcctcagtatgtgctgatgtttgggttgcttgtggaatcacagacactcctagaggagaatgctgttcaaggaacagaacgtactcttggattaaatatagcaccttttattaaccagtttcaggtacctataccgtgtattttt

SEQ ID NO: 883 - DNA, 300 bp, Homo sapiens
aattccgttgctgtcggtttatggattcgtgggctgcttccacctgctaggagggtggtgtactctaactcagggacagaagcccctgtctgtgctcaggactcttgcagacctctttacctggctgttcatcttccataatcaactggtagacgttacatccaagaggaaataatccaggcaaggaagcacaagctgatcaagatgtgtagttctgtggctgccaagttgtggtttttgacagatcgtcgcatcagggaagactatcctcaaaaagagattttacgagcattgaaggcc

SEQ ID NO: 884 - DNA, 300 bp, Homo sapiens
aattccgttgctgtcgataaaataatgcatgtaaggccctcagcatagtgcctggcacagaattactgctcaaatgttagctgtcgtattaatattgtcacttttgcacactgatgtacatttcctgttgaccaggctcattctttaagcattctccatgcttaaaccagttccataatccctaggcctgtactccagggattgagactgaaaggatcatttatgccatgtttctctaaaagcatcattgctggaagacttttgataagtctgatgtgtctcaagctattctcaagcctt

SEQ ID NO: 885 - DNA, 300 bp, Homo sapiens
aattccgttgctgtcgagcagttctttgaaactattctcaagttttgaacagaaagccatgctgttaaagcgccaggcttttgctgtcttcagtggagaacttgatcaataccacctttaccttccactgatacaagaacgcctgacagacaatctcagagttggacagacatccatagttgctgctcagatgtttctttttttcagagttttgctgctaagaatatctcctcaacatttgacttcattgtggccaataatggtctctgaattgattcagacattcacacagcttgaaga

SEQ ID NO: 886 - DNA, 300 bp, Homo sapiens
aattccgttgctgtcgggagctcctccggctctcccagaaacagagcaccgtgcagaacttccacagctgatcggcctcgcctcgcagatttgccaagtatccgcttcctgtggaagcaagaccaaaaggaaatcaactgagtgggtgtttggaagaggaaggagcaactctcgggcagcctgcccaagggagggagcaagttgcaatttagaagatgccatacgtcgtgtgacagctcatgagcctttcactgggctggcaattgtctgaacacttgggttcagttgaaatatatgtat

SEQ ID NO: 887 - DNA, 300 bp, Homo sapiens
aattccgttgctgtcgttttctttaaggattccccgttactactggtgatggagatgtatgaactgtgtatgttcttcaggaattataaagaagctgaagctaaacttctggagtttcagaagagccttgaaacgcttaacacagcagccacaaaggtccaccctgtcatccctgccatgtggctggaggatcaggtgtgtttccttttgaagcttatgctacagcagtgtaagacccagtatgagctggggaagcttttacagctctttgttgaaagagagcatctcttctctgatggt

SEQ ID NO: 888 - DNA, 300 bp, Homo sapiens
  misc_feature (1)...(300): n = A,T,C or G
aattccgttgctgtcggaaaattgggactgagctagagaaagaaggatcttaaaaccttgctagagaaagagacctgattccatcttcaagacatttgaaaccaaagacatttgaactggaactaaaaggttcaactcagataaactcctagttagattgaagagatatattcttcactctactcttggcaggaaacaaagcactttctctgggagaacctattttcttntttantggtncttttatnttccatggtntanntanncnaattttntttganactntatgttttgaatttt

SEQ ID NO: 889 - DNA, 300 bp, Homo sapiens
aattccgttgctgtcgggccattgctggtggccccctagcccctggctcccgggccagcatctcccaggggccaccaacggcttctcgcgcaggctgtgccctctctgctgagtcaagccggaccttgctggcgtgtgtgctgtgggtgctgaaaaacaccgagccggcgctcctgcagcgctgggccactgacctgacactcccccagctgggacgtctgttggacttgctgtacctttgcctggctgcctttgagtacaaggggaaaaaggcctttgaacgcatcaacagcctcacat

SEQ ID NO: 890 - DNA, 300 bp, Homo sapiens
aattccgttgctgtcggcagggtgtcctaggctctgagtctacagcagggaaacaaggagcctgctctcatggagctcacaggctcaaaggatgcagccacatcattggacctttcagtaggttccctgtgctgttaaagctcccgtgtgtgcacgtgattcaggctccaacaattcctggccaagataacagcacagaggccctggaccacctctgggtgttctgtacagtgggcccttgggggcctggctttcacccactggggtgcaatataaaccctcttcagatgccagaaccaa

SEQ ID NO: 891 - DNA, 259 bp, Homo sapiens
  misc_feature (1)...(259): n = A,T,C or G
attccgttgctgtcgcccttccctcctcctcagggtggggtgaacaaggctcctatcccaccccaccccaaaaagagaaaaatgaaaaactcatagtttggagccaggaggcagggtgtcctacagggctgcacagccctgaggggtcagtgctgggatctggttggttggtttgtctttttgtcttttttttttttttnncncantcntnanngaaattngttttaanccnccagngtngncnttaaaccaaagggca

SEQ ID NO: 892 - DNA, 287 bp, Homo sapiens
aattccgttgctgtcgcgcagaccatggcagccgccgacggttcgctcttcgacaaccccaggacgttctccagacgtcccccagcccaggcgagtcggcaagcaaaggctacgaaaagaaaataccaagcgtccagtgaggctcccccagcgaaacggaggaacgaaacttcatttctcccagccaagaaaactagtgttaaagaaactcagaggacttttaaggggaacgcacaaaaaatgttttctccaaagaagcattcggttagcacaagtgatagaaacca

SEQ ID NO: 893 - DNA, 300 bp, Homo sapiens
aattccgttgctgtcggtgccatccgtgctcaggtcccagtgccccaggctgacccacctctggtcagtgagtctcctgtgcctgagtgagggatatcgggacctgggggccctgccccgagcacctcccacccactgctagtgctggggctttgtgagtgttccaacttcatagccgagagttggaggacaaggctggggcagggccgaggaacggattgagtcctgcctaagcctcgggacatctaaacagctctggctctgccagacctcaggtgtgaccctgagccattttccttc

SEQ ID NO: 894 - DNA, 300 bp, Homo sapiens
aattccgttgctgtcggctactttaaaaagtcgttcatttttgttctcagatattttctctccagtatacctatcactgttgaatgttccccccaacttcccagtagtttggtttttagccatttcataccaatttatacttgtgctatgataacttttctaaagtctaaaacctaaacaaatagctggtggtgatattactttatgttcctgaggtgtagaaagctcttcagaatagcttctgctctttgtgagctccatatggcagtcaaaattaatgaaattaaaaaacaccatgcc

SEQ ID NO: 895 - DNA, 275 bp, Homo sapiens
  misc_feature (1)...(275): n = A,T,C or G
aattccgttgctgtcggtcaccagtcctcttccttcacttcttgttgtaattgcagccattttcattggattctttctagggaaattcatcttgtagagtgaagcatgcagagtgctgtttctttttttttttttctntngnccaaaaaaaaattngttanccanccnttnnntgggaagaaggncccnngggnnccattttttngggggancngggncaaaaaggcttggcnttaaaggancnttaanggtnaaaaancccattaaaaccaaac

SEQ ID NO: 896 - DNA, 300 bp, Homo sapiens
aattccgttgctgtcgaaagacctctagactgtgagctcagttatggagaacaaaaacagcttcatagtgagtagaacaccgaggataaacactggggccatgggtcctttctgaggcagcgccacagaagatctttgtggtccttccgtagttctgtaagtctgtctcctaagtatgggtagagaatatgtagcctgttgtgtgtctcccactacttgtaaacagagcatcacattaggggcagggaggaggtggaatgatatttgaggtgcttaaccctactcgaggaattaattatg

SEQ ID NO: 897 - DNA, 300 bp, Homo sapiens
aattccgttgctgtcggcagtagggggaggtgtgaaaggacttctgcatcagggcatagcatatgtttctgagatcactggaagaagctagcagtgccaggagcctaaagccagctcactgtttggtcgtccagtggagcaggtacagctcacagtccctaagccagggaaacctggctgacttccactaaagtcaagcaagcctggtcggcctcgattagccaaggtgtggactcttcctccaaagcccacctcagcccacctctgccagggcagagaagccaaaatggtcacattgca

SEQ ID NO: 898 - DNA, 177 bp, Homo sapiens
aattccgttgctgtcgaaagagattgccgatgaagaccccagcctcgtgaacttggataatggggacggtgcgacgccactgatgctagcagctgttacggggcatttggctctggtgcagctgttggtggagaggcacgcggatgttgacaagcaggacagcgtgcatggctggac

SEQ ID NO: 899 - DNA, 300 bp, Homo sapiens
cttaggactgggtcttggggaggattagcgcctagatgtctgattttggagctgcagcatgccaggccgtggctgagagtatgtgagccatgccttgcccttttctgaggctcagggaagtggatggagctagagagacaacaggaaagacggtgctgaagaacatagtgtctttcctctattgtggacctaaagaggtggggaagcaaggacaagaggcaaagagccacactgcccttggcatcatccaaagcattgtctggttgacaccaggtcctggttttgtgtcttttgtcaata

SEQ ID NO: 900 - DNA, 300 bp, Homo sapiens
aattccgttgctgtcggctggcactgctgctgtcaagcacaggctcctcgggctcccaaacagccctggcccaggttctgcaagaggttgcgctttccttctgagtaggctggagtgaggccctccagcccacagcccaggggaagaagcacacgtgcactttccaagccccacggcccaaagtaggccactgttaatgtcacagacagaaatcatggccaacactggaagggggctttccagtgagcgcccctagcaagcctgatctcccttcgtgttgactcttccggccagagagcc

SEQ ID NO: 901 - DNA, 300 bp, Homo sapiens
aattccgttgctgtcggaactgtttatcttatcctcctcagtgatacatcatgaagttgtgtgctttgcctaaaatgcccagttacctgaaattgtataaattcttgccaaaagtgtttgaacttaatacaaacttcccatctcttacctcttagcactgtgctcatcttgaggggacatagtcccaattttgtattttatataatactgttagtgaatatgtgtagacttcatatggttgtgggtaagagaatactgcattcagatagaaaagatgctatatagctaagttgatccagg

SEQ ID NO: 902 - DNA, 300 bp, Homo sapiens
aattccgttgctgtcggtaactaagagatatgcccggaaacaaaaccgatgggttaaaaaccgttttttgagcagacctggtcccattgtcccccctgtctatggcttagaggtatctgatgtctcgaagtgggaagagtctgttcttgaacctgctcttgaaatcgtgcaaagtttcatccagggccacaagcctacagccactccaataaagatgccatacaatgaagctgagaacaagagaagttatcacctgtgtgacctctgtgatcgaatcatcattggggatcgcgaatgggc

SEQ ID NO: 903 - DNA, 300 bp, Homo sapiens
aattccgttgctgtcgattggaagcaaaactaataatactattagcaatgacaccagccgagcagttgcagatccctctcgtatagaatctgaaatgtggatgatgctgttataaacagcaaagttagccatagcaacataggcactggtaatactgtgggtgggtctaagggtaacactgttccctgatcttactgtcatcatctgcaatctaagtaatgcagataataatggtgccccttggacttgacgccaatctcttggtcctattagaaccatgtaggcagagctattccaata

SEQ ID NO: 904 - DNA, 300 bp, Homo sapiens
aattccgttgctgtcgaaatactcctctaaagtagataaactccttgagtaaagagaagtttaccatagcaactttcagtagtacttcaaagaagatagctgtataaatgtcatcaaactatactatgtagagaatcttaagtgataaccagggtcacggattccaaacatgtcattataaattgttttatatggtgctcactggtgcatttttccttttggataagggaaaacattattccacttactgtttttgctttaagcagcctgcatatattggttagtttgttcagatgttgt

SEQ ID NO: 905 - DNA, 296 bp, Homo sapiens
aattccgttgctgtcggagaagttgagtggttgggacagtggtccccttcgtggtggaaagaacactgcctcagataatgtgtggctttcctctggtcagaggcccaaatgagtggacaagtactgtgatttctcaagcccctatgcagtgttagatgccactatgaaatacgagccattgaaagagatctcttcaacttattattttttatcacgaacgtacatatcagttatttatgagatttttttttttaaatatttcattttttttcacgactttttctgccattgaatta

SEQ ID NO: 906 - DNA, 300 bp, Homo sapiens
gtggtaatatggggtgttcagtccccataagatataatagttcatgcagtttatatattaaagtatccagtggaactaaatgtacaatatattcctaagtgcttgcctttttcactgtgctgaccagctgttcaagccacttcagtttgagtacaacataccaacatgacactactcacccacaaaggacagcattgggatcaggctttcagatgacctctaagatttttcccatttattgtactcttgttacaaagtactttttaacacatgcagtcaatggctataaaaactattctg

SEQ ID NO: 907 - DNA, 200 bp, Homo sapiens
aattccgttgctgtcgctttacttaaaaactattaacagtttttcatgttgcactggtggtaattttgaacttggaattactgggtgggaattccaggaaccacagagtattgatttttgctgccaaaatgctcttgaagcagatgtccctgtgctcccctggctgcttctggctgaaggggggaggtgtgggaggtttt

SEQ ID NO: 908 - DNA, 300 bp, Homo sapiens
aattccgttgctgtcgcttgtttttccacacagtggagctgtaactgcactaagatggagcaaacagatttccaaagaggaagattcagtaaattatagtgagaattgacaagaagtttctgtttatccattgaccagagaagggaaataattcatcaagtttagtttgaaggtctcaggatgttgaaatcagacttttacatcttaatccagtgagaatgaaaaatgaactacttatagtgtctgcccatgacaagtcatttctttgcttagggatgcaaatcgtatcacacagtggtc

SEQ ID NO: 909 - DNA, 300 bp, Homo sapiens
aattccgttgctgtcgaatcattaaggcatgaaccttccaccaacctaactgtcagaggtgcctctcccctctccaactccagattccttccccacatacctggctattcagtatcttctagcatttgctactcatttgtccaagaacaaggccctctactcccctgcctttttggttgttgttgttgtttttgacagagtcttgctctgttgcccaggctggaatgcagtggcatgaacacagctcactgtagccccaaccttccaggctcaagtgatcctcctacctcaacctcccta

SEQ ID NO: 910 - DNA, 300 bp, Homo sapiens
aattccgttgctgtcgactttatccttttagattctcagtctctttgttgcttgttgcaaataaatcatctagcaacatttacatttaattaggaaatctaacttgcttttaaaagttacccacgttgcatataaaaatcttgctattccttgtgtcttggctttacataagcacttttgctcatgtgactttgcactttgcacttattttaatcctctttaaagggctacaggcaaattctactttgccataatcacactaaggcatggaagaacaacttgcccagaatctagcaggtt

SEQ ID NO: 911 - DNA, 300 bp, Homo sapiens
agaatacaagccaaaacatggcttcaaaaggtcagctgcatcttcactggattacagaattcttgctgactctcagaagaaattgttggagagaatagtcatacctactttaaaagagaataaatagcctttcctaaattcctctgcttcgctcctttcctggcgttgctctggaaccttgttggtgtctgtgacccaatgactgttagggtcagctagcttcaattgcccctgcactggaagcaaggtttgtcagtaacaccaattaaaatactaccagtgtaagtagaaggtgtgttt

SEQ ID NO: 912 - DNA, 300 bp, Homo sapiens
aattccgttgctgtcgccatggttaggaagaactgttccacatacacctgacattggagtcagtttattgatatgtttggagattggcctttcaacagttttcatatttgaagaattagaaatgaagtccgttcagattctccaaagaacctccagccactggtgggggacattcttaattcacattcctatcagttggtatctcctgtccctgaagacactgatgaggcttgggaggagaatcccacctttccctgcagggggttaggctgggcagggcagggaggtgagggcgctggt

SEQ ID NO: 913 - DNA, 300 bp, Homo sapiens
aattccgttgctgtcgattcaagcactggtccttgggtgtctgacctctacattctagtttatgcaatgtctttagagaattttgtgcactggccactgtgatggaaccattgggccaggagtgctttgagtttatcagtagtgattctgccaaagttggtgttgtaacatgagtatgtaaaatgtcaaaaaaattagcagaggtctaggtctgcatatcagcagacagttttgtccgtgtattttgtagccttgaagttctcagtgacaagttttttctgatgcgaagttctaattcca

SEQ ID NO: 914 - DNA, 300 bp, Homo sapiens
aattccgttgctgtcgctggcctctgtgcggcgggctctctgccagctgcagtgggaccacgagcccaggacaggtgtgcggcgtgggacaggggtgcttgtggagttcagtgagctggccttccaccttcgcagcccgggggacctgaccgctgaggagaaggaccagatatgtgacttcctctatggccgtgtgcaggcccgggagcgccaggccctggcccgtctgcgcagaaccttccaggcctttcacagcgtagccttccccagctgcgggccctgcctggagcagcaggatga

SEQ ID NO: 915 - DNA, 299 bp, Homo sapiens
  misc_feature (1)...(299): n = A,T,C or G
aattccgttgctgtcggctcatcctgagaaagatgagttaatcctttttggaggtgaatatttcaacggccaaagaacttttttgtataacgagctctatgtctacagtacccgaaaggacacctggaccaaagttgacatacccagtccacctccgaggcgctgtgctcaccaggcggtgataagtgccctcaaggtggcggacagctgtggcnctttggaaggnngttngcatctaccaacngagagcaaatntaatnctntgacggtatgctncttccngttgcccacttcctctg

SEQ ID NO: 916 - DNA, 299 bp, Homo sapiens
aattccgttgctgtcggcagtttcccgttattttcttgcttgtcgttcccctacatttcctcctgatttcccaagactctctttgtggcttttgagggtcagccaaggagcaggcaagtgagtgaacaatcctcaggaaaagaaggaccattttagcttaacacttcctttttttttttaagaagaatataggtaaacaggtaatgattcttgattggagataccatttgactcttgatgaaagttgtacgaagatggaaatgagggatgattccaggcgttttagggggaaggctgca

SEQ ID NO: 917 - DNA, 300 bp, Homo sapiens
ccaaagtaacacaaatgctgccttcaaaatgaaaaccagttttctgtttattcttgctaaatgtttatgtaatataaatgtagtatgggttctggttgatgttttgtgaaaattatgttctgtttcatccagcgcaagtatttacttgatctgatttcttcttgatacaggttaaatgggccagggaaaactatcaccataacattggctcaccatattgcttacggttagcttctgctgatgtcaatgggaagatcatcgtctgggatgtagcagcaggagtagctcagtgtgagatcc

SEQ ID NO: 918 - DNA, 300 bp, Homo sapiens
aattccgttgctgtcggaaataacttcgaagtcctcttcctttacaatatttgaattcatatttgtaccttctcaaaatagtgattcatttttcctagaattacaggagggagctcttttactaatgttgttttgtttgcaactttgatggcttataataggaagtattctagttgtaaagaaaactctttagagacttttgactggtcagtatactgaggtgtgagatttgattcatgatgaagaaagcctatagattgccaaaaaattaattctccaaaccacctttcactctcagaa

SEQ ID NO: 919 - DNA, 206 bp, Homo sapiens
gagaagatgaccgagagactcttgtcagccaatgcagggacacactctgtgttaccaagaactggctgtctgcagatactaaagaagagcgggatctctggatgcaaaaactcaatcaagttcttgttgatattcgcctctggcaacctgatgcttgctacaaacctattggaaagccttaaaccgggaaatttccatgctatcta

SEQ ID NO: 920 - DNA, 300 bp, Homo sapiens
aattccgttgctgtcggcgcggaggagaagtggcgtcgagtccggccgggcagtagaggaaattgcggtagtgaccctcgggcctcgccatgaagagccgctttagcaccattgacctccgcgccgtactcgcggagctgaatgctagcttgctaggaatgagagtaaacaatgtttatgatgtggataataagacataccttattcgtcttcaaaaaccggactttaaagctacacttttacttgaatctggcatacgaattcatacaacagaatttgagtggcctaagaatatgatgc

SEQ ID NO: 921 - DNA, 294 bp, Homo sapiens
  misc_feature (1)...(294): n = A,T,C or G
aattccgttgctgtcgctgtgtttacacagtagtttggatgtacaattattattagtggctttctaaaaaatgaaacagtgttaagcgaactgttgttcctagctttgtactccatgttgtcaaagcatcaacaatgaaaattcgattaggaaactttatttaaaattttaggcntnctntattcantcgtantnanngccanncttaacccattgnatgaaaatctangactgtnttgaagcaagcanncatnacatcttntangnaggnaatantcntgcctttgcataaaa

SEQ ID NO: 922 - DNA, 300 bp, Homo sapiens
aattccgttgctgtcgcccacacagtttggcatgaaatggtcacttccgcatctagagcacacattatttttctgaagcaccctgttgaatgagaggaatacatacgtgccatcataggttgaaaaagtgatcttttcagcataaattggtgggtgtttgagagcattacttgcacagttcaacaatacagagctggaaatgcataaagaggacattccctgctagtcaacgaatacatagatctgtagctggaaattagttttaactttcaagtagtcaagaaacttttatgtccaata

SEQ ID NO: 923 - DNA, 300 bp, Homo sapiens
gggaagggacctgaaggctacacagccctgatgatcagtttctgaggggacccctctgggggaacagctccctcctctttcccagagctgactggaaggtctgtctcattctacacactgcatttgttacagaaagggaccaagtggggaaaataaagaacatggaacaggctgagagagagggcagctccattcaaaggacctaggtgtatgccaaaaatgagaatgaagattgaccagcgacttctttggcagagacctgggcaggctggctgatggagagctggggcctgtgaatac

SEQ ID NO: 924 - DNA, 300 bp, Homo sapiens
caagcgcagacggaaccgcgatggtggcacctttattagtgatgcagacgacgtcgtgagtgccatgatcgtcaagatgaatgaagctgctgaggaagacagacagttgaacaatcaaaaaaagccagcactgaaaaaattaactttactgcctgctgtagttatgcaccttaagaagcaggaccttaaagaaacattcattgacagtggtgtgatgtctgccatcaaagaatggctctcacctctaccagataggagtttgcctgcactcaagatccgggaggagctgctgaagatcct

SEQ ID NO: 925 - DNA, 300 bp, Homo sapiens
aattccgttgctgtcggaaagactacgtgctggcttgggcattttacatgacatagaaggcatccgctatgaaccaaaatgtcctcttggagtagacatatcaaaagaagttggagaagcttccataaaagtaccacaattaaaaatggagatatgatttctgctgttcaaaaaagtccctaaagggtctcactctctgacctcagctggagtacagtagccagatcacaactcactgcaaccctgacttcctgaactcaagaaatcctcctgccttagcctcttgaatagccgggacta

SEQ ID NO: 926 - DNA, 300 bp, Homo sapiens
aattccgttgctgtcgcctgaacctgaaaatcccaggtgggcgtcggggactagtagggtggggaagccttggctccagccttcagggcagtgggtgcctttgggaaccaagtttaggcatggcccagaacacagtatccaagtcggctgtgctgaccttttcatttcacttcatttcattatgttcttctatgtttattttcacagagtctcatccaagaaaaacaaatgtttaccttgctacctttttcctcttccaaataaaaatagctttattgtgtcacatgggggaaacgtaga

SEQ ID NO: 927 - DNA, 300 bp, Homo sapiens
ttttgcttgcattaccccaaagtttctttgtcacttacttcctgtgcagaagttgtctacctattctagattatggaaataactcagatgaggtagacaacttctgcacaggaagttgtctacctattctagattatggaaataactcagatgagcttcgtcagcaagaaggaagatgcatttaacattttttcccaaggctaaactatgtactataagttattcgaattagataaaaacaggaaaaaaatatatcactatagaatgtctagaaaagtggtttatgtttgttcaactgtt

SEQ ID NO: 928 - DNA, 300 bp, Homo sapiens
aattccgttgctgtcggatcagccagtttagaggacctgtgggaaaatctgagtttaaagcctgccaactcccctcatgtaaatatctctacaaccttgtctccacaagttattaatgaagtgtggcaagaagaaacaattgggcgtctactacaacttgtagaccttccacttcttgactccttactgaaacagcaagaggctgtacctaaaattcctcaacctaagaggcagtccaccatggtcaacagcagtaactatctggatcgagggattctcaaggcttatagtgactctcag

SEQ ID NO: 929 - DNA, 300 bp, Homo sapiens
aattccgttgctgtcgagattttggagtttgacttgaggggtataccactggacttttcatcttccggttgggattattgtgaaggattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccagg

SEQ ID NO: 930 - DNA, 259 bp, Homo sapiens
  misc_feature (1)...(259): n = A,T,C or G
aattccgttgctgtcggttttacattctatgattgaaaaaaattttttgaaaactttttatttcattctttcctgtaggattttgctacaaataactttgggaatgnatnaagtggaatgntaantttncagngngccnnanntntnntttttntctcgtanttgngaattcgnttnnttntgttttttnnnttnncaattttctttntaantncntngtgnntntnancnnntggtttgggtntnanattgnngttna

SEQ ID NO: 931 - DNA, 300 bp, Homo sapiens
aattccgttgctgtcggagattgttgtcttgaactctggcactgtacagtgaatgtgtctgtagttgtgttagtttgcattaagcatgtataacattcaagtatgtcatccaaataagaggcatatacattgaattgtttttaatcctctgacaagttgactcttcgacccccacccccacccaagacattttaatagtaaatagagagagagagaagagttaatgaacatgaggtagtgttccactggcaggatgacttttcaatagctcaaatcaatttcagtgcctttatcacttga

SEQ ID NO: 932 - DNA, 300 bp, Homo sapiens
aattccgttgctgtcgtcttggagctttcatttactaatgaggaacaaatgatagtcatgttatgacaatgtgttataaattaacaatcctcttttaaactagatttataaaacctacacacttgagggtttccatttgttctatctagatgtattttgagaaatctgaaacaaaagcttgtttttttgtttgtttgtttgttgtttgaaacagtcttgctctgtcacccagcctggagtgcagtggtgcgatcttggctcactgtaaactcggcctcccagattcaagcgattctcctg

SEQ ID NO: 933 - DNA, 300 bp, Homo sapiens
aattccgttgctgtcgggtttctcttgaattattttggaacaatgccaggatccaaactgattaagttacagtttaagcacccttcagtattaatatatacggtattatataacaggtcaacaagtgctctttgatgataaaacttgtaatagagcaataattgtaaatggttaccatactgtaagatattttgataaaaattaactagtaatacttgtatttatttgaaacactgggctgtttgcacagctccaactgtgcatgctcaaaatgtgcactttttaaaattgttactttta

SEQ ID NO: 934 - DNA, 300 bp, Homo sapiens
aattccgttgctgtcgagattttggagtttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggc

SEQ ID NO: 935 - DNA, 291 bp, Homo sapiens
  misc_feature (1)...(291): n = A,T,C or G
aattccgttgctgtcgcaaaggatagctgtggttgcattttttcctgagaatggagtaagtgattttcaaaaagcacaaataattggcagtcagagagaaaatggatggccagtgggtgttgagtcagattttgnncnntnncacacannnataacaanannttttaangatccngcncctacnngctttcntactgcgganacctgnnnacatcttactattccnnctctncntncaccgnngccgantacctacgnannnngtnatcntncttgcgcatntttgaacct

SEQ ID NO: 936 - DNA, 300 bp, Homo sapiens
aattccgttgctgtcgaaggaatggttgttcgcattaaatccatcatcttgagcactctcactctgcttttatctaatgttcccctttttttctctgttgctttcctgaagtagagagtgattttgtataagtgtaggataaaatgtttgagcagatgacaagaaagtctccattctgagtctctgttctttccaaattattaaactgcagggaatttgcccatatccctgggcaggtaacactacacaagagggagtgggttgagcatattatgtatatagatgtgaaatacagctgga

SEQ ID NO: 937 - DNA, 300 bp, Homo sapiens
aattccgttgctgtcgtatctatccatactatgattattaaatcttatgcggtacctaaacacaccacacccttttgtgttatttctgttcttttctacacgttcttcccactgattggagcacccctctgactcactggctaactgctactttttgttcaaaaatcagctgagagggcaactcatctgtgaattttttcttgacttccctcctcccaggctgggttaggtgcctccctatctctttttttacttaaattttttttctttattatttctttatttttttgagatggagtt

SEQ ID NO: 938 - DNA, 300 bp, Homo sapiens
aattccgttgctgtcgaaataagaagaagcaactgtacaaaccatgtaagtaaacactcaaatacttaagaaattgatagtttgacataaaaggatgtctctcttgatttctttaaattacaatgtggacctggtggtggtagcatggacctctttttgtggattttctaaatctcttctattttcctgagtattaaatttatccagaaaagtgtttagtttagcgtgtccaccttttaaagatttctgacatttaagttaaatttcaatagtctggttcaaaagatctgccttacggct

SEQ ID NO: 939 - DNA, 300 bp, Homo sapiens
aattccgttgctgtcggcagctggatggacactatagcaaacatcaatcaagagctcattaaatatgaattcttccctgaagccactcgaagtgaagaagacttaaagaaataccccaagtacccctgggggagagaaatctatactttagaaggtgttgtggatggagctccatattccatgatttctgacttcccttggctgaggtcattacgagctgcagagcccaacagcttcgctcgatacgactttgaagacgatgaagaaagcactatctatgctcctagaaggaaaggacag

SEQ ID NO: 940 - DNA, 300 bp, Homo sapiens
aattccgttgctgtcgggaggacatagccagggcggacaacatcttcacggccactgaacggaaccgcatcgactacgtcagctccgccgtccgtatcgaccacgccccggaccttccgcggccagaggtgtgttttataggcagaagcaatgttggaaaatcatctctaatcaaggctttattttcactggcccctgaggttgaagtcagagtctccaaaaaaccaggacacacaaagaaaatgaattttttcaaagttggaaaacattttacagtggtggacatgccaggttatggct

SEQ ID NO: 941 - DNA, 277 bp, Homo sapiens
  misc_feature (1)...(277): n = A,T,C or G
aattccgttgctgtcgctcagcttcaagttcctaagataagggctttcttaagctttcaggtgtatgtatcctctagatgtagacaataatgtcccatttctaagtcttttccttttgcttctccttaaattgattgtacttncaaatttgctgttanggnaattntctaatacnnnnannanttagatnctctantcganctntntnnnncnntnnctntantntatacnntnatattntctnntaaantncctntctctntncnantagcatctg

SEQ ID NO: 942 - DNA, 235 bp, Homo sapiens
aattccgttgctgtcggggagaggatggaaaaggcaccattacagaacaggtttctagccaaactttctagatactactggtgtcaaagatgaaggtcatgtgcagccatgtaagattagcccaaggagccagctcaaaccatgcacatccagggcccagcttggaattcatgttctggaggccttggctgggaggcagaatctgtgaattttaaaaacactttcatgaatccaa

SEQ ID NO: 943 - DNA, 280 bp, Homo sapiens
  misc_feature (1)...(280): n = A,T,C or G
aattccgttgctgtcggacgaattggaagtgctaagtattactatttcatgtggaagtctgaaaataactgcaccgaagtgttctgataaataactaaattgagctagtgagggggaaatttcagccgtctagagagtgtttctcttaaatattttttctctcaagtggaaaggagtgagggggagagcgaggatcacctangcctcncgcctgngcctctgccngancnngacncaacctccttcaacccncgnnaacnnaaggnngagcaccttcccc

SEQ ID NO: 944 - DNA, 300 bp, Homo sapiens
aattccgttgctgtcgagactgcagacatccatacctcaccacagaccaaagatgacctcgtgtcagactgtgggctgatgagaggtagagcagcatgcatcgaggcctgagggtgcagggcgccctctcttggcctggaggaattgctcctaactagagtaagtttccacgagggtcccaggcagagctgcagagctggaaccggaggctccacagtccttgcctgctcatggacctccttcagagcacctttctacagactggactgcccagctccgtggggtggcatctggtttctg

SEQ ID NO: 945 - DNA, 300 bp, Homo sapiens
  misc_feature (1)...(300): n = A,T,C or G
aattccgttgctgtcgatttaacttcaagtgtgctgcgagaaaacttcataatagttcctaagatgtgctaaaaagtaaagtccaaaaagatcataaagtctgtagagaagttctaagagtgcagtcagctataaaaacctagcaatttaatttcttagaaaaatgtagctggagttcaaactgtagtaacaaaggcaagtaaattaagttgtgggcaggtgtaattaagttaataggaatggcagggatgaatataaatcagaacaggactaacagnntgaaacattanatattcaaat

SEQ ID NO: 946 - DNA, 253 bp, Homo sapiens
  misc_feature (1)...(253): n = A,T,C or G
aattccgttgctgtcggtttgttgaaatgaatggacaaactcttaggataaatcctaatttgttggcaactgttatttgattttagaaggcaaactgattttattttagagaggggaaggngagggnaggctcattancctcttggaanaangaggantattnctgnnnatgaataggtnnncancttangtantgacngnnnttacttntnattatgnantgngnnttgncgttnnnnagnnnnntanacgt

SEQ ID NO: 947 - DNA, 300 bp, Homo sapiens
aattccgttgctgtcgcgccccggcccccttcctgccccctcttcccgccagcccgcctggagcaccagcctcgcgcgtccggaggaaccttggcttggcgccccatcctggtagccttaaacttcatagcactttgtggtttttcttaaaactctgagcctgtgcccgggcggatcacctgaggtcgggagttcaagaccagactgaccaacatggtgaaaccccgtctctactaaaaatacaaaattagcccggcgtggtggcgcatgcctgtgatcccagctacctgggaggctgag

SEQ ID NO: 948 - DNA, 300 bp, Homo sapiens
cgttgggcgagatgaagctacactgtgaggtggaggtgatcagccggcacttgcccgccttggggcttaggaaccggggcaagggcgtccgagccgtgttgagcctctgtcagcagacttccaggagtcagccgccggtccgagccttcctgctcatctccaccctgaaggacaagcgcgggacccgctatgagctaagggagaacattgagcaattcttcaccaaatttgtagatgaggggaaagccactgttcggttaaaggagcctcctgtggatatctgtctaagtaagatggagt

SEQ ID NO: 949 - DNA, 300 bp, Homo sapiens
ccctggtaccccctgcccgcgccgatataatgctttttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatgggggctggacccctatccccccaactggtgactttcccattccccagtgtggcatccagtgcccctcccctgactg

SEQ ID NO: 950 - DNA, 297 bp, Homo sapiens
  misc_feature (1)...(297): n = A,T,C or G
aattccgttgctgtcgagaaatttgaaaccagttgtcagttttcaggtgcccaggagcatgacaatatgcccgagggaccgtaacaggacttgacatggagctgggtctaaagcagatgacctggtggctgcagcgtgttccacacaggcgagcactgtgaggccaaaggactggtgttgagcagaatgaaaaagcacagtgttggttaatcctgaaaagtgaagcctgcaagaaatgaacttcgaccttggagtgggggtgggacaggggctanaaggaanagaggctnggaagtg

SEQ ID NO: 951 - DNA, 300 bp, Homo sapiens
aagcaacgggtccctctagctttgtgttgcagagactaaattccaggagggtccagccaagaggtcagggactccctacacccaacttccactctaggtggaggctttaccataggtatggcaggccaagacacagggccttgatcaccctctccatacctcactcaagatggattttccatgccagaagtaagccaagaacaccagaggctattgtctcaactgagcccataaagcaggcatgtaactcccagagagtcaggccgctttcctcactcctagctccagagtgtaatgccc

SEQ ID NO: 952 - DNA, 300 bp, Homo sapiens
aattccgttgctgtcgcttttcctttttaaagaaggctgctaattggattttggtagttcttacctcaagaaaacttgaattatttgggggaaagtaggctcaaaagagaatatatctttcacattcacattcagaacccagcaacctggagtccaattttcagtattttaactacctcaataatgctatgaatgtaagatattgggatagagatcccaacttgaaacaacagccagtgcctgtggtaacttaatgtcttgtcaaatacttttattgattggtttatatgccattcttgt

SEQ ID NO: 953 - DNA, 300 bp, Homo sapiens
aattccgttgctgtcgcttgtacagtatttctactttttattctaatcaactggactgttgcattatttttatgtagattgctaacaaggtttttgaagaaacactcttaaaagtcataaaagggaaaatcttgacagttctgggatattgccacccttgaccttttggagaaatgtagacagcatctcccaggcatgacgcctagggatcgtgtttatctgtcatcagttggtgactccatgtttattgagcactggctataagccagacttggtgagggactgaaacaattacaagac

SEQ ID NO: 954 - DNA, 300 bp, Homo sapiens
aattccgttgctgtcggaagaattgaaagagcaagtcatggaagtagaagaagatccgcaaaccataaccactgaggagacaatggaagaagacaagagccagtcggatgtagattttcagtcttgtgaatcttgtaccaacagtgatagagcagaaaatgaaaatggctctagatgcttttctgaagataataatgaaacaacaatgttaattcaggatgatgaaaaccattcagaaatgtcaaaggattggcaaaaagagaagatgtgcaataagattaataaagtacattctgaagg

SEQ ID NO: 955 - DNA, 276 bp, Homo sapiens
  misc_feature (1)...(276): n = A,T,C or G
aattccgttgctgtcgcccagtgcctgcacggcttggtggggtgggtgcatggacatgcggccagctgcggggccctgccccaccttcagaggacactgtcctccgagtactgcggcgtcatccaggtcgtgtggggctgcgaccagggccacgactacaccatggataccagctccagctgcaaggccttcttgctggacagtgcgctggcagncaagnggccatggnacnaananacggcgccacggntgncccacaccgaggnnngaaccctg

SEQ ID NO: 956 - DNA, 247 bp, Homo sapiens
  misc_feature (1)...(247): n = A,T,C or G
aattccgttgctgtcggtggacacctctgatgaggaaagcatccgggctcacgtgatggcctcccaccattccaagcggagaggccgggcgtcttctgagagtcagggtctaggtgctggagtgcgcacggaggccgatgtagaggaggaggccctgaggaggaagctggaggagctgaacntgangnnngngatcaggngngcnnggncgatgatgnngnagncnagtctnnncngntnntcccac

SEQ ID NO: 957 - DNA, 300 bp, Homo sapiens
aattccgttgctgtcggtacgatacttaaaaccatcacaagctgcccaagcaatagaaaactgtgatcgaagttttagagcaatcttggctgaacctaaaaataaagcatctgaatcctctgaacaagattattatagtaatatgaggcaagaagctttgggacatgaacctagagtaaatatgtttccatttgaacaacaatctgaattttcaagttttgacaagaatgatagccgaggccaggaagcaatctccaaacgcttgtcagttgtatcaagagttcctttcactgaagaaca

SEQ ID NO: 958 - DNA, 280 bp, Homo sapiens
  misc_feature (1)...(280): n = A,T,C or G
aattccgttgctgtcgctgtgagccaacattgtatgtgtgtggatatttacaaatgcaccgttggattctttgtcgttcaagtgaatgttgactatttacaggtaaagaactctcttgtctttgtagatatcaggttatttgaatcaagtaatatttgcctatctatttatacattaatatgtttaaaaagaaatttctccaagaagaacattcgtcattcattatttgnttgatgagatgatacttacatttttatngtgtantcatnnnanatctaat

SEQ ID NO: 959 - DNA, 300 bp, Homo sapiens
aattccgttgctgtcgcacaggactagcagtgagcaggcagatccctcagcaccctgccttgccccatccagcttgctgtcccctgaggcctcaccctgccggaatgacatgaacactaggactccccctgaaccctcagccaagcagcggtcaatgcgctgttaccgaaaagcctgcaggtcagccagcccctcaagccagggctggcagggccgccgaggccgcaacagccgttctgtcagctctgggtccaaccggactagcgaagcatcttcctcatcctcatcatcgtcttcctc

SEQ ID NO: 960 - DNA, 300 bp, Homo sapiens
aattccgttgctgtcggaaaaggcaaattcttagaattttaaagggttttctctcaagtagttttaaaatttcaaatgatggtgttgtatcccttcccttcagacctggaatcacattttcccctcaagacagaaagggctctgcggcaggttgtgcctgggaaggggctgcttctcatttgtggccacctctctgcccaggagctggtgaggaagggtgaactaggggatgcctttcagaacaaaggaggtgaggagatgagcccctccacatctgccccaaatagagaccggcgtact

SEQ ID NO: 961 - DNA, 300 bp, Homo sapiens
aattccgttgctgtcggagcaggcatggtggtgcatacttgtagtcccatctacttgggatgctgaggcaggaagatcaccggagccaggactttgggattgcaatgagctatgatcatgccgctgcactccagcctgggcaacagagcaagaccctgtctcaaaaataaacatagtattagtacaatgaaaagacaaatcgagaatagataatacaaaaatagccttatagtaaccagacttactgatgaatgccacagacccggagtatgtcacatggtttatcaggtgaattaataa

SEQ ID NO: 962 - DNA, 300 bp, Homo sapiens
aattccgttgctgtcgccttcatggacctgccagcctagttggggagaaggactgggcccaataccagaagctgatccaaagtggtcagaactggggaaggagacctgtgagctgaaagcaggtaaaggaagtatccagacagaggcactggtaaaagacctggagctgggaagggtctagggaccagggacaggttgtactgtaattctggaaaccttgtgaggctcaaagaaaggggcagagagctcagtgggaaatagaaaaggcacctgaacagtccagggatggctttcgactac

SEQ ID NO: 963 - DNA, 300 bp, Homo sapiens
aattccgttgctgtcgctgtggccatctttccttacacgtggggaggaatcagcctgagaatgaaaccatcacaggaaagggctgaaagacggcaagttttcactgggtcttacccgacgtgagcccccactcctccatatggacctgttttggaccaatgaggcatcctcttctgtagtcctcaacacgcggagctccaccactcctgagcagtgtgacctcaggtgcttgctgcagaggcatcgggggtctctggccagaggtgacatctgaagcaatcgggatcctgtttggttttg

SEQ ID NO: 964 - DNA, 300 bp, Homo sapiens
aattccgttgctgtcggtataaggtgtctcagcacctgtttgccttctattccctttagaaggtaagtaaaagtaatgggggaaaggattaggtggagcctgtctaaacattctagtgtgtcttggcaaacatagcctgaaatgattcttaaagaactggcattgtttaatcaaatatttttaagggagattccttaattgggaagtttagtctgtttggggttcaaagagtaaatgaggattagaaaatcatggagagaggctgggcgcggtggctaacgcctgtaatcctagcacttt

SEQ ID NO: 965 - DNA, 300 bp, Homo sapiens
ctgctttgaagaactaggttggaaaaccaccaagggtttagtccactctgcccccaaatcctgagtctgctgaaccagcaccaccgccttcggtgttggttcaggaagttgcccttgtctggtagggagggtgagcctctgaaataagggttgggagtcatgcagtgtggccttggtccctggggggggtgttaaaactcaagagaagggggaggaagggctggggcactgccctgaagccatttccctcctcaccagcccagacaccaacccagggtggcgggagccacattcatcccc

SEQ ID NO: 966 - DNA, 300 bp, Homo sapiens
ggatctgaccctgattggggagagctgagtgctgagccttgggagcccctgccagccacctgcacctgtggacagtgggtgggggcactactccccactcagagcacaaatgcaactccttcccctacaatcccatcctgagccattgcagggggcagggaagttcaccccccccaccacccccccgcccccccgaagccatgtcactgaaaaggcctgggggggatggtatatggccctttccccaccaggcgctaaggggaacacccccttccccaggtcttttatttgtttaagtta

SEQ ID NO: 967 - DNA, 300 bp, Homo sapiens
aattccgttgctgtcggtacatttttgcaattgttttcctctaatgagttgtaagacagataaaatgtgaaaaattggcattaaacatcacttgggaagagtttgtttctttttagcttgaggttggtaaaatggatttatttactccgcgccccccccccctgccccccgcttccatttgggctgaatactaaaaggtttttagagagagagaaagtttcagggggtttcataccctcagtttacaatctgagaaacattttttttaaaagcttccttccaaacctgtagcacattgcc

SEQ ID NO: 968 - DNA, 300 bp, Homo sapiens
aattccgttgctgtcggcaatcctcccacctcagccttccaaagtgctgggagctgtgagctacacctgtgagatggcacccttgtcctgctgcatattttaagagttctgtttagtccatcaattgaggtcaggaaaatgaacgtgctgaaagataatatgtaatgataataatttgtagacataaatgccagccgtgtctgttaactatttcaggtgatattgtactaaatctctgaaatcacctgtgatgaacttttaaaataaataaaacttttaagtcacagtgtgattataatt

SEQ ID NO: 969 - DNA, 300 bp, Homo sapiens
aattccgttgctgtcggtctttggttgctgttctttcctagactcttcagaaaaaaatgaattaactagcaatgcttaaagaggtagtaaatacaagccaatccattttcattccagctgcatttcatgcttcagagtaatggctgttagccagaatcacttgtgaagctttatacacatatacattctgtgatcttattccctgtaaacccctattcagtagtcggtctgtgatgaaatcccaggcatcttcattcaggttaaaaaaaatatatatatgtctacatgaaattctggtat

SEQ ID NO: 970 - DNA, 300 bp, Homo sapiens
aattccgttgctgtcggttctcatggctatggctaaagtgtaagagggtaagcctccttgtacaagctcatgtaagattcttgcttatgtcgtgactactcacatctcattggccaaaacaatgcccaaatttgccaaagtccatggatgggagggattgcaatgttatattgaaaaagcttgatacatagaggggtggagaattggagccagtcattcaacctaccccatatcctttgcacagtcacattaaataatgaataacatatttcttatttgattatttaattggttatctcc

SEQ ID NO: 971 - DNA, 300 bp, Homo sapiens
aattccgttgctgtcggggagaatcaccctcagcacccgccaagacctgcagacacacctgaaaccagagggcaggggcctgtggctcctggtgaaaccttcattcattgcctgtgggcactgaggtcatcaagttcaggggtcactcatggcagggatgcctggtactgagagactcagggctcctgcctccctcctgggactgtgcaaaagatccctccccccagctgctgccccaccctgatcaggggagggggctgggcaacctagttgggggagagggggccactccctgtcctc

SEQ ID NO: 972 - DNA, 300 bp, Homo sapiens
aattccgttgctgtcggagagactgaaaacagagaaaaagttgccgcctcaccaaaaagtcccactgctgcactcaatgaaagcctggtggaatgtcccaagtgcaatatacagtatccagccactgagcatcgcgatctgcttgtccatgtggaatactgttcaaagtagcaaaataagtatttgttttgatattaaaagattcaatactgtattttctgttagcttgtgggcattttgaattatatatttcacattttgcataaaactgcctatctacctttgacactccagcatgct

SEQ ID NO: 973 - DNA, 300 bp, Homo sapiens
cttggttgggataaacttgtgtatgcggatacctgcttcagtaccatcaagttaaaagcagaagatgcttctggtagagagcatttaatcactctcaagttgaaggcaaagtatcctgcagaatcaccagattattttgtggattttcctgttccattttgtgcctcctggacacctcagagctccttaataagcatttatagtcagtttttggcagcaatagaatcactaaaggcattctgggatgttatggatgaaatcgatgagaagacctgggtacttgagccagaaaaacctcca

SEQ ID NO: 974 - DNA, 200 bp, Homo sapiens
  misc_feature (1)...(200): n = A,T,C or G
aattccgttgctgtcgggacagtgtaggtctaggagacattaatactcacatccactaaacatcaaggtacagttattttgagtgccactaagaggtgaatgatgtttccagagaccataacatgaacccacttggtctgtaggttaggggtggcctctctgtggtggggggangggatgnnnnnnnnnnnnnnntnnng

SEQ ID NO: 975 - DNA, 300 bp, Homo sapiens
  misc_feature (1)...(300): n = A,T,C or G
tttttctactccttctttttgcagnttcccatttnattcgaattccgttgctgtcgaaagaatccacactgcccaggtcggggagcagtggtggccagcagccctcagggatgaaggagggtgtcaagaggtatgaacaggagcatgctgctatccaggataagctcttccaggtggcaaagagggaaagagaggctgccaccaagcactccaaggcatccctgcccacgggcgaaggcagcatcagccatgaggagcagaagtcagtccggctggccagggagctggagagcatagagg

SEQ ID NO: 976 - DNA, 300 bp, Homo sapiens
aattccgttgctgtcgggcaggggaggggcttccaggattcacaggggcagatgggagccagcagtgggcagctgggagctgcgactcattcaaagagagggagttagtgcagggtaccgagatcaggaagaggagtggtgcagaggtgggaggtgatgagactcaagactacagagagaagaaagggccggcagcccagatcccagccccacccctcctgccctgcattcaggcagagcacagagggataaagagggaggtgggttgggggacaaggcagagatgcatatacctgggac

SEQ ID NO: 977 - DNA, 300 bp, Homo sapiens
aattccgttgctgtcggtaagttatatctcttaactggattctatagttttatctcgagcaacttggaaaagctaagacatcctccacccacactggtatctacgcgcctggaagctgcaccttctctcattgctgtgctctgctttaaggaaaacctgatatgacagaatcaagactattaaaagataaatgaggggaaatcttcatttaagaaagttgccttgctccccaagagtgcctttaattgctattcccctaggcatctgggtgcatatcattaatgaaatcattaacctttg

SEQ ID NO: 978 - DNA, 300 bp, Homo sapiens
aattccgttgctgtcggtagaattctgattggcatgggaagtgttttccttggtttgaaattgggcattggcaccaattcttcagtaccaattctaggaggaacaatggctgttagccatttcccccacatatctgagcttcagcattttaaataagcaacaagtgggtatggtttatttttggaaccagcgtgaaggcagctgacacaactcatctgggttgcctggtgcttgcaggggcccaaatgcataacagaaattctttgtgcttcatatagatgaatttgaacagttccacct

SEQ ID NO: 979 - DNA, 300 bp, Homo sapiens
aattccgttgctgtcgcttttaaagtcaaaggggtgtacactctgtgatgttattcgtaatatcataggaaggggttattcctaatatcacatgggttatcctaggaagaggttactcctaatatcacactcctaatatcacagcctgtgatagcattcggaatatccaaaagggatggtacttttaatgtcacatggggtgcacaccctttgataatattcgtaagatcctagggacatatgacttcaaatatcacattgggtgtacacacatggtgtacacattgtgtgtgaacacct

SEQ ID NO: 980 - DNA, 300 bp, Homo sapiens
aattccgttgctgtcggtgtgactgcctgccctcctctgcctcagtggcctgactcagtggccaagggacctatccatctctgaggtgagagctttcctgtcttgactggtctccaagacaaggtgaacagggacctcacctctacctccttcttagggggcgagaacagtactgccccagtcaagaggagcacgggggaatggggggtccccacccagtttcaagaccgactccgcctccctaggagtatggatgtagaaagatatgtgaccccacaatagcaatgggcaaccctggac

SEQ ID NO: 981 - DNA, 300 bp, Homo sapiens
aattccgttgctgtcggtcacggtactttgcccaaagtcaccccgatgtcaagcgttagagcaagaatttgaaccccagagcttaactcttaaccattttgctaactggctgtctctccaggcccccatcaccctttccatcaccctcccctgccccaggggcatcctatcaaatggcagttcccccctcgcttgcctcagcatctccaatttagagcttcatggatctcctcctgttgaagtcatgggatggatttcccatctcagaaactgcacaagaaacaaccttggagttttgaa

SEQ ID NO: 982 - DNA, 300 bp, Homo sapiens
  misc_feature (1)...(300): n = A,T,C or G
aattccgttgctgtcgagatgaacagcccccaggtcccaccctcccagccgctgcggccctgggcagggggtgatgtgccccacaagacacatcaagcccctgcctctgcctcgtcactgcctgggaccggggcccagttacccccccagccccgataccttggtcgtcccccatcaccaacctcaccaccacccccggagctgatggatgtgagcctggtgggcggccctgctgactgctccccacctcacccagcgcctgccccccagcacccggctgcctcagccctncggactcgg

SEQ ID NO: 983 - DNA, 300 bp, Homo sapiens
ctggccctcacctcccgccgtagctggctgtgacgcccgccatgggcacactggggcagtgcagtgagaagacgaggatgcccagcaggctgacaacggtgcagaacaggcagaacttgatgaccgcggagccccggagcctgagcttgttcacaaagaagccgcccaggaaggtgccgccaccacccgctggcaccaccagcctctcaccagagcagactgtcggcctcacatcacccccacctgcaggagggcggctctttcctctcggccacacctagagcctggttccgatgaacg

SEQ ID NO: 984 - DNA, 300 bp, Homo sapiens
cccgggccagcgtcacagttggaggagagcagattagtgccattggaaggggcatatgtgtgttgctgggtatttccctggaggatacgcagaaggaactggaacacatggtccgaaagattctaaacctgcgtgtatttgaggatgagagtgggaagcactggtcgaagagtgtgatggacaaacagtacgagattctgtgtgtcagccagtttaccctccagtgtgtcctgaagggaaacaagcctgatttccacctagcaatgcccacggagcaggcagagggcttctacaacagct

SEQ ID NO: 985 - DNA, 296 bp, Homo sapiens
  misc_feature (1)...(296): n = A,T,C or G
aattccgttgctgtcggacatcacagcccctatgaagaaagtagccacaatctcaaataacaaaagggaatgttctaaaactttttcttccttaaaaatggagaaaattgcacttgtgcttgctgtgtggtatataaaccaggattagtcccagggtcgtgaggtttctggtgaaaaggttaaatcgtagaagctagtatattttttatatttttgtaacaattgcttttttcatgggggaggcggggtangtatttatagncctaacaagtccagtaattttttataaatcttca

SEQ ID NO: 986 - DNA, 300 bp, Homo sapiens
aattccgttgctgtcgaggtgcaggtgttagtgcaggaccggaagggtgaggtgtcctaggcctcggggctcctggcctgggctggctgaggcaggactctgccaaaagtcccctgccaggcctcatggtggtgctcctggtggcagtggctctctggccgcgggccctgtctgtgtctccgtggtggctctcacagggctctccagacactccttgactgcatccttcagtcttggcccctaggcctggggccccttgggagcttgcctgacctcccttcctgggctgggtagccatgg

SEQ ID NO: 987 - DNA, 300 bp, Homo sapiens
aattccgttgctgtcggctgagcatactgtaatagtcataagtttaatttcattataataaaaataatcaaacaaaaggactttagaacccaagacaatgagctagttttccctaaagtttgctgaactattaaggaatatgttcttatagcttttgactagaatgagtcatgggaattctaagaagggatggcctagacatttttagctcagttaaattcagcatttaatgcaggtgagttcctgggtcgttttccaactagtctggaacagtctggttctgactcaaactggtataaa

SEQ ID NO: 988 - DNA, 258 bp, Homo sapiens
  misc_feature (1)...(258): n = A,T,C or G
cgacacgctgctggcgctgcaccagcacggccactcggggcccttcgagagcaagtttaagaaggagccggccttgactgcagttgcaagaacngnaaggnaaangaagnactntccaaaatnanagngngnaatacttcnnaganttcttgtgngttattttnnnnananacnttcatattnanttttnttttnatntntatntnttattnnnatttnanagnaatanttattnngatnnntnttntanttcattnt

SEQ ID NO: 989 - DNA, 300 bp, Homo sapiens
aattccgttgctgtcgggaggacttgaactcctcactaacatgtagaattgggctatttcccactcgaaagtactgacctccagctttcctaaaatcccaccgcacatgggctagcaattctgagatgaaagcggaagctgtcattcccaccagtgtctcaggcgccagggcagcctcctcagggacgtccctgcctcctcattgcactccacaaccacagcagagcatccacagtcgtaattaggcaattcttcttaaaaaatgttatgtaattagcacaccatagaattccccatttt

SEQ ID NO: 990 - DNA, 298 bp, Homo sapiens
  misc_feature (1)...(298): n = A,T,C or G
aattccgttgctgtcggataaccaaaacagtatatgtaggtagaaaagagaagagtgtaaggtcttagctctggaggactggtgatatttaaagcttagggtgataaggaataggaatagagagtgagaacgaggggccaggaaatgtaggaaagctaacaaagtatgttattctaggaatgaaagagaaagtgtatcatggaggatgctgatngnctgcntcncacgtttgtngnctagnctcatngctntaatnnatnnanntcttgattntgtcatttcntnannnnctacctct

SEQ ID NO: 991 - DNA, 300 bp, Homo sapiens
aattccgttgctgtcgctcaaggcttcaaacagcgcagataaatgcaggcaagaaaagatgccgccgttgctgccgtcaccgcctcctgggtcgtccgccacgggttgcactgccgtggcagacagctggacttgagcagagggaacgacctgacttacttgcactgtgatcccccttgctccgcccactgtgaccttgaaccccatgcactgtgacctccccccttctcccccttcccactgtgattggcacatcgacaagggctgtcccaagtcaatggaaagggaaagggtgggggt

SEQ ID NO: 992 - DNA, 300 bp, Homo sapiens
aattccgttgctgtcggtttcttaacatttctagttgtctgcaaccatccctgtcttacattacattattaagttagttctattacaagactaatgaatgacagaatagagcaaacatggactttggagtcagacagacatgagtcagataagagttcaaacccactgactgccgtaaacttgggcaagagatttaaccctgtcagggcctcagtgtactcattagtaaaggtaataataagtctgtaggaaataatacctacatacttacatttgacatatatttaatgctccagctta

SEQ ID NO: 993 - DNA, 271 bp, Homo sapiens
  misc_feature (1)...(271): n = A,T,C or G
aattccgttgctgtcggagtttttgctattatattttatcagatgctaacatatccctaacttctggctgattctttgctttaatcctttttatctatcagtcaccaaatacttaattgattccttttgctgggaaaaaagccaaaaaaaaaaaccaaactgcccacaaggaacttaaaatcatttatggggattngnatncagttnntngncccangggcgcggnatnnnngcnccccnnnanntnccngggnttangnngtncccacgg

SEQ ID NO: 994 - DNA, 300 bp, Homo sapiens
aattccgttgctgtcggtgatttgtttctattaaaaataattttcaagtggtttcttgtactttagtatgaagacattgagtaaatataagaagcataggaacagtatttagagaaatcagtaaccttttgtttaccctattttgaatcctaaaagaaaaagttcagttatcatggccaggcgcgatagttcaggcctgtaatcctagcgctttgggaggccaaggcagacagatgacctcgtgattggcccacctcagcctcccaaagtgctggtattacagatgtgagccaccgcacc

SEQ ID NO: 995 - DNA, 300 bp, Homo sapiens
aattccgttgctgtcgatatatttggcttctataaaaattaaaaacccagggataagaagaaggggagagaattggaaagcccctggttagctttaagggcctctcagtgcagcagaacacatgctggctctattcataactttgctctctggatcaatattctgaaagttggtacattcttttcatttgtgtctttcacagagggcagtaaaatttagctctaattatatttagggcatctggattctagtcagcattttctggctccgttttagaacctaaagtctgcggcttattcc

SEQ ID NO: 996 - DNA, 300 bp, Homo sapiens
aatccgttgctgtcgaatgggagccatgctactggtttatttacaccaagctggatggtttccttttaggcaagaaggaggtcatcagcaggctcccaacaataatgccgaagttaacaatgatgggcaaaatgcaaacaacttggaacttgaagaaatggagcgtcttatggatgatgggcttgaagatgagagtggagaagatggaggtgaagatgccagtgcaattcaaaggcctggattaatggcttcagcttggtctttcatcaccaccttctttacttcactaataccagaggg

SEQ ID NO: 997 - DNA, 300 bp, Homo sapiens
  misc_feature (1)...(300): n = A,T,C or G
ctagatttctgggaaaacgtgactcgggttcctctagagaagcagtggcagatgagagtacaaaggcaatggggagctggaggaaggccttaagcaggggcggcggcatggtaaggtttgtaggaggactggctgcagcagaggcagggagaccagtgtggagtctgctcagcagcccactgggaaggtggtgatcgccgtggtgatgagcagttcttggtagctgcatgtgaggagggtgacaggtcaggaactctagctcaggaaaccctgtggatggtggagggnaagatcagtctg

SEQ ID NO: 998 - DNA, 300 bp, Homo sapiens
aattccgttgctgtcgcaattgaaaaacacagaactgtacggaatttaaaagtggaaatatggcatctatcttccttgcattccacgcaggtgtcatccagccacaccctcctctctgcagctctctctgcaagcacttaacacctggcatgcaccttccagacctttcttgtataaacatgcatgcatcgttttgttgttttctaacaggatcactatatgtgccattctaccacttggtttttttaattcaacaaaatgccatgagtatcctttagtctttttatggacagccctagt

SEQ ID NO: 999 - DNA, 300 bp, Homo sapiens
aattccgttgctgtcggcggagatggtcaccagaattaaaggctgggagaatactgaagagctcaagtctattgagaacttagaagaggccattagttctggccgagagaaaagcattcaggatttttacaaagttttggtaaatcccagtgagcgcaaagctagactgcagtagatcgagaagtgaatagaaagtgacaaacacagacggagtgaaaacaactctttcagtaagttcagtggtggaggaaagatagcttaaagaggaggtaatagtagagtcagaaccttcaacctggg

SEQ ID NO: 1000 - DNA, 300 bp, Homo sapiens
  misc_feature (1)...(300): n = A,T,C or G
aattccgttgctgtcggattttctccctagagtgactttgggtctgtcacaggacttgctgctttcccaagtataaaagaacaactgtattttagaaggggctggttaaaacaccaggaaagtactggttaaatataatctttgtactttagactgtgttcttatcacatatcagcctgataagaggcaacagtttcaaaaaagtatttcacttttgtatttctaggtggaacagacaagttcttcatgttgttggggtaggggcagtggagggtcaagntcattatcaaacttttagat

SEQ ID NO: 1001 - DNA, 300 bp, Homo sapiens
aattccgttgctgtcggagaaaccaaacaggtaaaagcaagtggtgaagccacatggattaatgagatgatagaaagtacaaaatcactatgtaagtcagattaaaaagccagcttgcactctctgctttcatctttttgaagcaataactattacataaatcagtgaatacagtatttctacagtatttgaaacggtgttcacacccagcaattccacttctagacatatatccaagagaatggaaaacatgtgcacacaggcacttgtacatgaatatttatggaagcattattcaca

SEQ ID NO: 1002 - DNA, 300 bp, Homo sapiens
aattccgttgctgtcgggtttcgccatgttggccaggctggtctcaaactcctggcctcaggtgatccggccgctttggcctcccaaagtgctgggattataggcatgaaccaccacacctggccaaaagcaggtctttatttttaatgtccaatttatctgcttaattttgtctaaaaagatgatcttaatgcatacattagatgataatttcctctttgttccacttcatttcaacataattttttcccatatagtgtcttttaacttttttaaagaggggatatttgaatgagacta

SEQ ID NO: 1003 - DNA, 300 bp, Homo sapiens
aattccgttgctgtcgccaaagtgctgggatgacaggtgtgagccattgcgtccggctggaatttcttatggttcgtttccttaggttaaagattcagaagtaggatttttgaattaaagaaactaaatactgtctatggcgcttgatacatcttgccaggcagttatcagacagggttgtactggtttgcgccaccccagaacgtgtgcaaggcctgtttgtggaccctccttggcctggctgtctaggtcatccacctgcgtgtgctcacagagcatatggatttttccctgcggtgc

SEQ ID NO: 1004 - DNA, 234 bp, Homo sapiens
  misc_feature (1)...(234): n = A,T,C or G
caacaacatggtctctgtccctctctctttgactctccctttgtcctccccatagagctggggtggggtggatccctatacctggggcaggcagccccaaagtgggggagggggatggcagagactgtaaaggcgccactggactctggcaaggcctttattacctttactcccctccctctcccatcaccagcctcaaggcctgaggggtgcaggggctcctggnagctactg

SEQ ID NO: 1005 - DNA, 300 bp, Homo sapiens
aattccgttgctgtcggccaggtactattagaaataagacaaaaatctctgcctccaaagagctcccagagctcttgggagtaagggtttggagtggggcagacaaaagtacacaaaccattggaccacctgagccaggggctgtgatagaggcctggcgatagtgggcttggcaggaagcacttgtggccatttgggaaaggggcacattgctgtaagatgctgaatggccaatgcctggaataaggagggtgtgcctgtggcaaaggaatatcccaggtgctagggtccagcccagaa

SEQ ID NO: 1006 - DNA, 300 bp, Homo sapiens
  misc_feature (1)...(300): n = A,T,C or G
aattccgttgctgtcgatgaatagtactcaaagtgtttttgttgcactgttactctgaatatggactctctatatctggtatggcgtgactgcgcataacttctgtaatgtatttcagttatntntntttccttntatngccnncttatgatnatgacacnctccncnnggatgnagatatatggaaccatatnttataanaacccctgnccnntnttncttctgaccttcagttcactttgtcgcccttggagaaagctgttnttctttaactaaaaataaccaaaatgctaaaaaaaa

SEQ ID NO: 1007 - DNA, 300 bp, Homo sapiens
aattccgttgctgtcggataaataagatactgatgttgtagatttctttttgcaaagattatttctttaccaaatttagcttgtgacttatcttgcagttataagacattcctaacatgtgactgttaaagtcttggagatggtagtatggtttctttattacttttcattatttctcatgcaacaaaatagagcagagtttattttaaaatgtgaaaagttacactaatgaaattcattttattagtgttgaaaataaggaagtaattagagcatttctataataaataagtaaccatc

SEQ ID NO: 1008 - DNA, 300 bp, Homo sapiens
aattccgttgctgtcggcaggggtcattccacattaccagagcttgttccagagaggcagtgggaggctccacaggcaggcttggagggtgcttggccctaatactaaatgttggacttcatggcattaacgaaggggaatcactggagccttttagtatgaagctaatctttttgtccatcacaggcaacttcttgcctacactcttttacaatatggcatttatgacatagccaagagcgaagacacgttgaacactgacttaatgctttgagtaggtggagagttgaatgactcaag

SEQ ID NO: 1009 - DNA, 300 bp, Homo sapiens
aattccgttgctgtcgcttgtttttaatggctcaactgtctgatgtaattgagtgaaggtttgcactgagaaattagcattcaggccttacccccatgaagtattactgttaacatatgttcggactgcttcccttcaccaatgtgaacaactttttttcccaaacagtgttaaaagccactttgcaacacttgacttcatcttaatgtacattcactgttgttacatacatatctaagtaaatcaaagttttgggtggaagtgttgagaagtatgagttttttgttgtttttgttttac

SEQ ID NO: 1010 - DNA, 300 bp, Homo sapiens
ccgaaaggccttgtctgatgccattaaaaaatggcaggagctgtcaccagaaaccagtggaaaaaggaagaagagaaaacaaatgaaccagtattcttacattgatttcaagtttgaacaaggtgacataaaaatagaaaagaggatgttctttcttgaaaataagcgacgacattgtaggtcctatgaccgacgtgctctccttccagctgtgcaacaagagcaggagttctatgagcacaaaatcaaagagatggcagagcatgaagactttttgcttgccctacagatgaatgaaga

SEQ ID NO: 1011 - DNA, 300 bp, Homo sapiens
aattccgttgctgtcgcggaaatgtccgaaggcagcagtacttgaccctgtattttgggagtcgaacggagaatggaaactgaaagtggaaatcaggaaaaggtaatggaagaagaaagcactgaaaagaaaaaagaagttgaaaaaaagaaacggtcacgagttaaacaggtgcttgcagatattgctaagcaagtggacttctggtttggggatgcaaatcttcacaaggatagatttcttcgagaacagatagaaaaatctagagatggatatgttgatatatcactacttgtgctt

SEQ ID NO: 1012 - DNA, 300 bp, Homo sapiens
aattccgttgctgtcgcccagagactggctcccagtgagctaagcccagccgcgacccttggatgtgccagctgatttaatactcatgataaacccagtaggtcagtgccagtattatgagagaagtgaggcacagaatgtcacatccacctccccaaagtcaacagctaggagtgacagagccaggattctgccaggcaggttggcctcagaggccacacttcttatcccaataataaaagtgaacaagaacaggatgaagttagagtgagagagcgagagtggtaacactcatgcaat

SEQ ID NO: 1013 - DNA, 300 bp, Homo sapiens
aattccgttgctgtcggtttcatcttctttgcccatgtacttcactcagtccataatgctcacctctgcctctgaaactgcccatcccctaagacccagctcctttgtcacctccagtgagaagcctccgctgcttttctttcctcctcttggtcccctgcagcactttctttgaacctctgttttggcacttaccatgttgtttggtgagggctctgtttacttgtctgtttctttcactgggctgatctcctgtagacaggggactttgcagaacatgtggtggagaggagtcggtgg

SEQ ID NO: 1014 - DNA, 298 bp, Homo sapiens
  misc_feature (1)...(298): n = A,T,C or G
aattccgttgctgtcgagcgattagacctgtcataaagtttgaaaaattgattctggaggcgaagtgaatagattgagcttgacagtgttgtcctaaagattctaagggaaaattctgtagtttaatttgaaatcccttgattattcattagctttccagatggcttttgttgatgttttacatattaatgcctgtattgtgttattggtgtactcttaatgtgcacataggtaatgagcanagaatanatacattggtaagtgtcccanattaatgggatattancgtanttgcgaa

SEQ ID NO: 1015 - DNA, 278 bp, Homo sapiens
  misc_feature (1)...(278): n = A,T,C or G
aattccgttgctgtcggcttactactaatcaaagaaacagattaaaactacagtaagatgtcattatttaatttattgattgtggaaagacaaaagtaccagatgataccagatgatgacaaggggtaaacaggtactttattttatttatttcttaaacattatctttttttttttttgnaaanaccnngccccccgggtggnnggncgggnnnccantntaanttggnngnaccntnncccncggggnnnaagggnntttnccnncntaacccccc

SEQ ID NO: 1016 - DNA, 260 bp, Homo sapiens
  misc_feature (1)...(260): n = A,T,C or G
aattccgttgctgtcgggaaagtcgtggagggtaagcacagtcctgaagacacaggatggaaaccccaggatgagaagggagcagggagagttccagaaagggggatgaaataggagtattaaaaagctgcgttggccagttnttcatgnancnnttgntgcnntnangcgtatnttanccttgctntatantcttntnctntnnnnttncnnntnntantntaactttnttntntnnacnnnnnnnnnntncgntgnnt

SEQ ID NO: 1017 - DNA, 300 bp, Homo sapiens
aattccgttgctgtcggcaagcatcaccgctgtctaattccagagcatttctgtcaccccaaaaagaaactccatgcctattagcagtcactcccagttcttcccttccttttctcctacctcctttgactaagcctccctcccctactccctcctttccttccttccttccttcttctctatcaatataatcactttgtttctttcaggtgagatcggactggaactgttcggctgcgaccagaaatttattttcctgagtaaattgccgagaattaagaatgaagagggccatttgca

SEQ ID NO: 1018 - DNA, 300 bp, Homo sapiens
aattccgttgctgtcgctagttataaaagtgtaatttctactgtgtcataatcagccatgcagctggagacttgccctctttgtacagcaaagttgtgaaaaaaagtatttgcactacatttatttaaacattaggaaaaaaagccaacccatgcttttctttgccgagatgtagggctgtattattggctagtgagaagcctgggaacactaggactttgtgtgggctgattgcaggtatcagatccgggattatacaggtactgttggaagtatcttggggattttcctgataagaac

SEQ ID NO: 1019 - DNA, 300 bp, Homo sapiens
aattccgttgctgtcggaactctttaagaaagctcaacagggaaatgaagctctagatgaaatctgttttaaagtttgggcctgtaatacagtccgtgatatactggaaggcagaacaattagtgttcaatttaaccagctatttcttagaccaaataaagagaaaatagactttcttcttgaggtatgttcaagatcagtaaatttagaaaaagcttcagagtctttgaaaggaaacatggctgcttttctaaagaatgtgtgtctggggttggaagatctgcagtatgttttcatgat

SEQ ID NO: 1020 - DNA, 300 bp, Homo sapiens
aattccgttgctgtcgggaatacaaatagatgacctgttatctgtgtcagcttttgatactatctgcccttcacgtctttattcttagattgtcatctgtgggtggaaaaccttaagtttctacccatagaaataagcccaccatatttcagaaaacatggtgggtcataggaaagcactcagatgggacaacctagttggatttggtacaaaatgagccagatgtgggaaaaggcaaattaatatgattatgaaaagtaagaatgatggagctgggtgcggtggctcagcctcccgaga

SEQ ID NO: 1021 - DNA, 300 bp, Homo sapiens
aattccgttgctgtcgattgattttagtggtattggagaaaattaaataattaggaggcatgtttaaagacatctacaaagcatcctaattaatttggagtgagtctttgggatggcttcccaattctgagtcccaagattaaacaggccaatcttgggccgggcaaagtggctcatgcttgtaatcccagcacgtcgggaggccaaggtgggtggatcacctgaggtcaggagtttgagaccagcctgaccaacatggtgaaaccccatttctacaaaaattacaaaaaaatttagcct

SEQ ID NO: 1022 - DNA, 300 bp, Homo sapiens
aattccgttgctgtcggtggggtttcaatgagagaatgcgtgtaaaatgcttcgtacaattactgccacttatgtctcaataactgctggctttggtcattaataaaagagggaaacaacattatcagatctgtatttagaaggagttctggcagatagggacagatttgtgccaaaatctcaagacagtatttttcaagattacactgaaacttagtacatatttatattatcatacatttttaaaaaggtcaagatgattatagttgaaaccacatagttctttttttaagaaagtca

SEQ ID NO: 1023 - DNA, 300 bp, Homo sapiens
aattccgttgctgtcggatttgtactattaagagagaaaaaatatgccacacaactaaacataggttgaaattatgaagaaatttagaatagaggtttattagatttagggaacactaagaacaaaaaaggaaggagtgatacctgcctgagtggacagctgtaaatcagctgtaattactgcagttgtaccaatagttgtgagtggctccagtcactttaggagtccttggaagtacttggtacacatttgttggctgtaccttaaaggaagtggcaagtccagtttgttctctctacc

SEQ ID NO: 1024 - DNA, 300 bp, Homo sapiens
aattccgttgctgtcgataactttttactcatatcattgtccctatattagtattaagagcattttgtataaaacttcatgtgaggatctcaattctttataattctcttcaaagcaaggaagtatatatagagagacctttattttttagtaattttttcaaatggtttgggagatcttattctagcccaattctattctggcacttaattattttctggtggcttgtaatatggtaaatactggattccagattgcattcctatttccttgggaggtgaggatactcccatttgtaca

SEQ ID NO: 1025 - DNA, 300 bp, Homo sapiens
cgcgcgttccagagctgggcgctgcagctgcactgccgatcgccgtgtttggtcgatagaatccccagtgtgcccagagagtgcgacccctcgcccggcccggcgagccccgggcgtgaaccgaactgagggaggatggcagcctctggggtggagaagagcagcaagaagaagaccgagaagaaacttgctgctcgggaagaagctaaattgttggcgggtttcatgggcgtcatgaataacatgcggaaacagaaaacgttgtgtgacgtgatcctcatggtccaggaaagaaagata

SEQ ID NO: 1026 - DNA, 300 bp, Homo sapiens
aattccgttgctgtcggctaccacccgctcctggtgtctgagttttagcagagcttttgccctctgaggaccccaccccagcctgcagatatgaaggtggcggtgctgttccctgggagggacccctgaatagatggacgggagggactctggagccaagggtctccgcaacgtcactgtgtggatgggaaccctgagatccagggttggccagggatgaccacaggcatcattcacaccactccttcaccgcaggcctgcctggggtcagtggcgccagccccacccagcccctggact

SEQ ID NO: 1027 - DNA, 300 bp, Homo sapiens
aattccgttgctgtcggcaacttcaccatcccagacaattctcgttactcccgtaacatacattgcttaataaggttcatgcttgaaccagatccggaacatagacctgatatatttcaagtgtcatattttgcatttaaatttgccaaaaaggattgtccagtctccaacatcaataattcttctattccttcagctcttcctgaaccgatgactgctagtgaagcagctgctaggaaaagccaaataaaagccagaataacagataccattggaccaacagaaacctcaattgcacca

SEQ ID NO: 1028 - DNA, 300 bp, Homo sapiens
aattccgttgctgtcggttcatatgcagacaaagcaccttcaagatctttgaatgaacttaaacaatacggatttttctcttatttgagagaattatttgatgcacctgatcctgtaatgagttacctttgctgtcagtatcatattcatgaagttcctgtaggaactgaaaagaccagagaaagaattgaacgggtaatacaagaaacccgattaaaacagatttatacagcagaagaaaagtatgtggtgaaaacttctttttattcaaacaaagttatttctagtaacacatctcta

SEQ ID NO: 1029 - DNA, 257 bp, Homo sapiens
  misc_feature (1)...(257): n = A,T,C or G
aattccgttgctgtcgataatttctctgaaagtctttagtgacaaagccaaatatagtattcttgatttttacgtcttcactctttacccccttttatactggtttcttctcagattaacatcttatattcnatgaagnngangganatntattnctggctttannnnntntacnnccnnnngancnnctntgtnnccnntnnnanancncnngtncnnatttttnnntnctgctgaannnccanttctcnctntta

SEQ ID NO: 1030 - DNA, 300 bp, Homo sapiens
ataatactaaaatatttactttagtgtttcttgacattcaaaaatgtcattggatttgtaattcaggtatcatatttgaaaatgagtcttttaaaagataacataaatatctttattttgacacacaaggtcaagactagaaatgtgttcctgggtactttcagcctacttggtttaatcaaattgcttttgaatatgaatgtcctaatttaattctttggacctttgaggggaggacactatcacttctacatatgtagagaagtaaaagtctcatagatccatcttgctttaaaaata

SEQ ID NO: 1031 - DNA, 300 bp, Homo sapiens
aattccgttgctgtcgattcctctatatttaattttgaaaacctaaaagaaggattgtgcatcttgagagaaagttgagcaaattgtgatctaccggaatgttaatttgtgctgcttcttgtgcacgatagcagcagtagtatctctcttggaaataaacatcccatattatgatgtctatgaatataggtttccttttcttccttccctccctccttcccccacctttctcttttttttttctctctcagcttctcttttcctccttccctcttcccttcctctttctttacttttttt

SEQ ID NO: 1032 - DNA, 300 bp, Homo sapiens
aattccgttgctgtcggcggggaggacgtaccttgtgagatgcgagccggccaacagcttgcaagcatgctccgctggacccgagcctggaggctcccgcgtgagggactcggcccccacggccctagcttcgcgagggtgcctgtcgcacccagcagcagcagcggcggccgagggggcgccgagccgaggccgcttccgctttcctacaggcttctggacggggaggcagccctcccggccgtcgtctttttgcacgggctcttcggcagcaaaactaacttcaactccatcgccaag

SEQ ID NO: 1033 - DNA, 300 bp, Homo sapiens
aattccggtgctgtcgacaagaacaaggttgatagcgtttttcttgacacatgcactttaagctccaagaggaggcctcgagtcagctcacaacaacatgccaacagtgactctgtgcttactttgtgccaggcagtctctagccacttcacatctcacttaagtttttattagagtcttaatgaagtgtgctctctccgacctatgcccattactcaaatgctgcgggtctatttctttacttataaaatgaggttaataatgcctaaaaaaggattgtcatgagaattaaacaagtta

SEQ ID NO: 1034 - DNA, 300 bp, Homo sapiens
aattccgttgctgtcggtttaaatgttttcttcgggattaaaaaaacctgaatgtattctgggaaaatgttaaatggatgcaacactataagattttccacagaaatatgttattcaccgtgaagcacaatgggaaggctccattagcactttagatggtatcataactttggaaaaaccatttcaccatgcgagtatttacaaaaactgaagctgtccctgtcaggttttgacagagcttagctatataggtagtaagtgacgcagtgccaaaaccagtcttaaattacctatgttgtc

SEQ ID NO: 1035 - DNA, 274 bp, Homo sapiens
aattccgttgctgtcggggaccacatcctgcttcatgtcagtgactcctgccccttggtcttcagtgtttttctcttccccaggagggactttgatcatgcaggatagaattctcccatcgcacacctgggggcaagttttagatgagcttctttcctccatttcacctggtggtctgaggacacacagagggtgggggtgagcaggcagtgtgggtgggaggggctacctcccccagaccccttacaaactctgtacctctcggtgcgcggca

SEQ ID NO: 1036 - DNA, 300 bp, Homo sapiens
  misc_feature (1)...(300): n = A,T,C or G
ttgcgtctgagacttctantccgntcttgttctttttgcaggatcccatcgatccttcctgaccttccacctccaccaggtgccgacacttccctgaccccagtaacctcttctcttgggtgggtgaatgccacctgctgatgtctgatttattcatcggttttcttgtctgtagtctgtcccccttggggacagggactcgttgctcatgttcacccggcaggctggacacttcgtggagggctccaaagccggcagatcccggggccgcctctgtctctcccaggccctgcgtgttgc

SEQ ID NO: 1037 - DNA, 300 bp, Homo sapiens
  misc_feature (1)...(300): n = A,T,C or G
aattccgttgctgtcgaaatattgttttaaaatgcatcagcctatgctatacaatctgaatgttattttaacttataggtttttttaatatatatatttaactataaggacagtttagggaacaagttacctaccacatttcactttagtgtacctatttacagaaagattaaactgccacctgcgggcacattcccataaatgtgnactttactttaaaaagaacatgccacgattttgtctttctgtggactcaacattcacttcgattaaaaatagcaatttgaccaagttggactt

SEQ ID NO: 1038 - DNA, 300 bp, Homo sapiens
aattccgttgctgtcgcttctccacctcatctcagcttagggactggttagatcgtccaggtgacaacacatgcttctgaacctacacatctgccttgctttctgaaaacaattttctaatgtttttgaaaaagtaatgtatgcatgtattgtatccatcagaatcctagaaggacacagagaatgctcttaaactggggagtttctggagagtttaataaagatgtgggctgggcgcggtggctcacacctataatcccagcactttgggaggccgaggcgggcagatcacttgagctc

SEQ ID NO: 1039 - DNA, 300 bp, Homo sapiens
gtgaaaaactatcactttcaacaatgaagaatagtaatatgtcataatggagattatgaagttcagaaaggggtaaatgcagttttggggagggctgagactaagagagaacacaataagacaggcaattaagactgacatgaaagatcagtcacattgataggatatactcttgatatgatataatgagaatggcagtttaccgctgtggttttcttttcccaaaacccataaccacagcctaaccatgagaaagacatcaaacaaatcccaatttgggacattctgtagaatacctaa

SEQ ID NO: 1040 - DNA, 300 bp, Homo sapiens
aattccgttgctgtcgggatcctcatgcggaagaatttgaagacaaagagtggacatttgtcatagaaaatgtaagctaatggcaaattccttcacctttcacattttcaactttatatatgcattattaaggtacattggcattttggtggtaggaaaaatgttgccttaagaaaattaaatagtgatttgtagcttttagaatgtttttaatgaaatgatagccagtaacaaaattatttgtaagaaatgcttttattaacactgtaagtcttcaatactaaattgtatgtatgtttg

SEQ ID NO: 1041 - DNA, 300 bp, Homo sapiens
aattccgttgctgtcggtggttttaaacaccacttttgagatgctaaaaattcagtcccaatgggacttgttcaaattcagttcagtttctggtcatcaaaaaatcaatctgttttaagatctagtcttacccatgaaaactttaataatggtagatatctaaaacatgagttaattacccccaaaatgtttcagttttttcattgttatattgccaaaaaccattctggctatatatatttttaaaagaagccatttgcatgtcctttagtggtagaatagaaatttggttaaaattgg

SEQ ID NO: 1042 - DNA, 295 bp, Homo sapiens
  misc_feature (1)...(295): n = A,T,C or G
aattccgttgctgtcgggagcacttggggtccaagaatggcaagatcagcaatcagcaagaagatcaccattgctgactggacaactgcaataaatttgacgggtgtttctcttaaaaaaaaaaaaaantnctgggacanaccanggacccntgngttcncatgtcntggggnccagtttttaactggggaanccgnggnnggcntggaaaaggaggcagtgnccgngactgtgctgttttccgaagccccntgcctgctgcctgttcctcggtcctcggggctggactggcgtt

SEQ ID NO: 1043 - DNA, 300 bp, Homo sapiens
aattccgttgctgtcgctcaaaggcactctcatgacagacggcgtggggagcacagaggaggctggcagagctggggactgagggcattgttgctgattctcactcaccggggcagcctgccgcagatgcacaggccccaggtgcaggccaccacctccgggtcggcaccaggactgccctcggtgctcatagggaatggctgggcccacggaaggtcggcctgggatgtggcctgggactgctgctctgctggctgctgtgtggatgcttttcctggagcactttccaaggcatccccc

SEQ ID NO: 1044 - DNA, 300 bp, Homo sapiens
aattccgttgctgtcggtaggaaaaatcccattctaataaggttatatttatgtagctctgcaaataaacatctagcaaatgtaaaaagtattttctttgccttaaaaatgattaaaattatttgaactcctgaggagtgttatatgaataaaattagtaagttatttggaggaaagttattttttaaaaagacaactggtaaaacagtacaggagaaaggccagcttcctcaagtgaggacagttgtttagaattgactgaggagcggccgggtgcggaggctcacatctgtaatccca

SEQ ID NO: 1045 - DNA, 300 bp, Homo sapiens
aattccgttgctgttcggtctgcgtacgcctggagtccttccccgctgtgctcagcatggaccctatcgggagcttctgcgggaagctgcggtctctggccagcacgctggactgcgagacggcccagctgcagcgagcgctggacggagaggaaatctattgtttagattatccaatgagaattttatatgaccttcattcctaagttcagactctaaaggatgatgttaatattcttcttgataaagcaagattggaaaatcaagaaggcattgatttcatacaggcaacaaaagtac

SEQ ID NO: 1046 - DNA, 300 bp, Homo sapiens
aattccgttgctgtcggaccaacttgatgatggcatctcttttaagatgcccaagtctgcgcacttttattcctttattcggcccctagcaccccctccccaccccaaagaaggtcagttgcatgcgtgtggggatgtagctcaaaaaagaaataagatggagtggaaaggaaagaaaggaagaagcaggaattcaaggtgggtgggctgagcttggggccacctagcccacctgctccaatcaagggctggaacaaacctgaggccacttggagaggcagggctgggcagggacagggg

SEQ ID NO: 1047 - DNA, 300 bp, Homo sapiens
ctacttgttctttttgcaggatcccatcgacagatcctggtaccccctgcccgcgccgatataatgctttttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatggtggctggacccctatccccccaactgctgacttccccattc

SEQ ID NO: 1048 - DNA, 300 bp, Homo sapiens
aattccgttgctgtcgggaggtcggactcaggaggctccttctccactcccggaagatcatgtaccagcccagccggggtgcggcccggcgtctcggcccttgcctgcgcgcctaccaggctcgaccccaggaccagctttatccagggactctaccattcccacccctttggccccactccacgacaaccacttccccatcttctcctctattctggtctcccctgccccacgccttcccacccagcgtcttccccaggttcccccactacctctccctcagatccaggccctcagctc

SEQ ID NO: 1049 - DNA, 300 bp, Homo sapiens
aacaaaaccaaaaagatgcccctttttttgtagggataagaaatacatttgttttatacttctatgctatattttgctattcaaaatttagtgggcattacttaacattgtttctaattattttgtggctgctgtatgttttatgtgttgggagcccattgtattaggccgttcttggattgctataaagaaatacctgagactgggtaatttggttttttggttttttggggttttttttgagacggagccttgctctgtcgcccaggctggagtgcagtggcgcgatctcggctctat

SEQ ID NO: 1050 - DNA, 300 bp, Homo sapiens
aattccgttgctgtcgggacatttagtctgcctgggtttgaatcctagcattgtcatttacaggtaagtatcatcttgggcaatgcatctataaattgggataataataccaaattggaacaataatgataggttagttgtaatgattaaatcaaataatgagagtaaactcctggagtagtgactgacacatggcatgtaataaacatttttctttctacgaggtattgatatttattaacctcttaaaagcaatttggactccctttgtctcttattgtcctgtgacagttaccatga

SEQ ID NO: 1051 - DNA, 300 bp, Homo sapiens
aattccgttgctgtcgaaatggaggtagggacagatctttcaagggaggtgtgggttgtttatatttttaacacaattgtaggcttctcttttgagaaggtagatttccgtgttgtatctgatcatggcagtgtctcagaaggctgagtgtctgccttaagtttacgttgtcaacgcagtttagagggtaaacatgtctgtggacatagttgaactgggtttttgaagatgtaattaccaatttacatcatggccaaattggaattattatttttaattggaattattatttttaaaaaa

SEQ ID NO: 1052 - DNA, 300 bp, Homo sapiens
aattccgttgctgtcggtgcagtggcacatacttgtagtccaagcttcagaaggctcaagtgggaggatcgcttacacccaggagattgaggctgcaatgagctgtgatagtgccactgcactcagcctgaatgacagagggacaccctgtctcaaaaaaaaagtcagtttctcacttggactaactactttttaactgttaatagctggtggctgccatactggacagcccaagactagaggctcaatgggctgttctccactctctgtccaagggaaccttcctttatgtgctttttg

SEQ ID NO: 1053 - DNA, 300 bp, Homo sapiens
aattactagtgggggagtaaggggacaggccattgggcatactggagcagcatttactcagtcattgagaaaaggatggaacattcaataaagggtgctggacacatttgtgctctaaaaattttgtgtttcacctattaatttatccctccccttagcccctggcaaacactgatctgtttactgtctccatagttttgcctttcccagaatgtcacacccttggaatcatacagcatgtaaccttttcagattggcttcttttacgtagtaatatgcatttaggattccttcatgcct

SEQ ID NO: 1054 - DNA, 300 bp, Homo sapiens
aattccgttgctgtcgcacaaatactcactgttgaaatacactggagaaacatatatataaagtgttaagaataaaatatgacccatatgcacaaaacccaggcagatcattcttcaagtgtaaaggccatggataggtgctcgcaagcatgaaagcccttggggaagatggtgtccaactttgggttggggcccgtgggaggctgaacaaaacctagccattggggagctgggtgaagtcagagacaggaggactggtaggaaggagagaacctctttccttatagaatgactaagcaa

SEQ ID NO: 1055 - DNA, 300 bp, Homo sapiens
aattccgttgctgtcgagattttactattatacactaaattttcaataatgattagaatctgaaaaaatttgaaattgtgaataaaatgcttttaaacattttatcaagcattacaaaagtagagaatagtataatgaagcaacaccaagcttcaaccattgatacatggccagtcttttttaatctatacccatccctcttcagtcatcccccttccaccctaaattattttgaggcaatatctctaaaagatgaggacatttttaaaaacaaatataattttattatcataaataaaa

SEQ ID NO: 1056 - DNA, 300 bp, Homo sapiens
aattccgttgctgtcgggggctgttggcataatcacaagcctgtctgtcttcgagaagggacagtggagtcatccaggggctgccacatgacaggcacggtgggcaccgatccacagtgggccccgccttccccagctcgcctccctgcctgtgctggcctggccttgcctgctggcaccattggagtaggagggggtggaacacagggggcccatcctgatcaggccccatctcaaggttggcactcctgcccatcacccttagaaggatcttttcccatggcttgacttccttcattt

SEQ ID NO: 1057 - DNA, 300 bp, Homo sapiens
aattccgttgctgtcgggatgctgaaggcctctttcccccctgctgttgtgtggggatcaaatcagttgggggcctagacttaaaagggagcacgtggttaggaaatctcattagctgacaatttaactccactctaatgctcgtccaaagagcccggacaaagacttcctctcctttccctttgcagttctttctccttgctcctctcttctcccctccccctctaaaccagaaaggaaaagcagcgttgggcctgtctccttccccccagattcctgcagttctagtgtgccgactga

SEQ ID NO: 1058 - DNA, 300 bp, Homo sapiens
aattccgttgctgtcgctcaattgttgttttaagattgaccttacctgtctgttgaaattgaccatagcacatccttgatccttgagattttactattcaacctgtttttctgtttttgttgttgttcttttcactccctgaaattaggagagtagtacatatttgtgtcttccacagacgatacagactttaagatgtagaagctcatggttttatagatgaagggatttggaactcttcccttcagggtcaatgtacttgattgtctgaattaaacttggttcccaagttaataactc

SEQ ID NO: 1059 - DNA, 300 bp, Homo sapiens
aattccgttgctgtcgaaaaaaaatttaatttgaacacttctgttttgtgcagttttctctgttatattttactttttaaaaagaaaaagcggctgagccaccacgcccagcctcacatttttattttaaaaacctctccaggctgggcgcggtggctcacgcctataatcccagctgttagggaggcagaggtgggaggacagctcgagcccaggagttccagatcttctgcctgggcaatataatatagcatgaccctgttctaaaaaaaaaaatctctgaaaaagatgattcaaaaa

SEQ ID NO: 1060 - DNA, 300 bp, Homo sapiens
aattccgttgctgtcgtgaaaaaggaaaaatcacaataataaccacaaaagtacaaaagatcattacagactattatgaacttccatatacttacaaactagaaaagctagaggaaatggatacatttctggaaagcaagaaggaatagaaatcctaaacaggccaataatgagtagtgatattgaatcagtgatttaaaaaatcttccaataagaaaaagccaggaccgaatggagtcatagccaaatcctaccaaacatataagggagaactaataccaatcctcctgaaattgtgcc

SEQ ID NO: 1061 - DNA, 300 bp, Homo sapiens
aattccgttgctgtcggatagggcaatccaagagacatagtcctaaccccagagtagcatgtaatcccttcttagcatccctctttgaaaactgaagatagtacagctgagggaactgaacaggttcccaggatcatagagaatcattaagctgaagcaaacaaacaaacaaacaaaaggcaaactagaagaaaagcaggattcaatgggttctgcaccttcttagtctatcattgctttgtaaacattctccggttttacattactacagaatatggtccagatataaagttctactgt

SEQ ID NO: 1062 - DNA, 285 bp, Homo sapiens
  misc_feature (1)...(285): n = A,T,C or G
aattccgttgctgtcgcacaactggccagtggcagggctaggatttgaaagcagttcttttccattttggttgttggtgactcaaagtcattctgaactttcagaattcaggtggttgatggggtggggtgggggtgtcngtntgnntctnttnttcctctttaantgctcttatcnncntannccatgnatnannnctnctnnnnnngntcatctntncnntctanngatttcntttgtnannaactttnnatcgnttgtcnnatgannntnnntgttctatct

SEQ ID NO: 1063 - DNA, 300 bp, Homo sapiens
ctctccccccctccctctctcttcctttcctctctcttgttgtaactgggagtggaggcccactggctggggagacattaggtggtggggcccagcccgacctccaggttcttccttctccctagctgttgctttggtctggccactcccagcccccttgtccccttggaagcttgccctgccctcatcttgcccatgccttctactgccaggagacttgcacccatttcaaccctagggcgggggcaagtggggcaaggatggaccagcagaaggggggtaaggctctgttcacttccc

SEQ ID NO: 1064 - DNA, 290 bp, Homo sapiens
  misc_feature (1)...(290): n = A,T,C or G
aattccgttgctgtcggaccttacctgtattccctgtgctatcctgtgggaaggtaggaatgggctaagtatgatgaatgtataggttagggatctttnggntntaaatcncagacaanctaattcaaactggcttaanatganaaggatttatngnttcatgtaactagaangatnntancnngngtttgnttcngnnnaagantnngncccncggnngaattaccntntananccnnangganttnggntttaaanntngtgtnnnntnagggttntgnattaaaaaa

SEQ ID NO: 1065 - DNA, 300 bp, Homo sapiens
  misc_feature (1)...(300): n = A,T,C or G
aattccgttgctgtcggagctcgtgagtgggcgccgccgccaccgcccccgccgccgtcgtctcggtagcagccttcgccacgccggggtcttcagctccactggggccatgtcagagcgagaagagcggcggtttgtggagatccctcgggagtctgtccggctgctcgcagaggacgtgtgctatcgtctgagagaggccacgcagaatagctctcagttcatgaagcacaccaaacgccggaagctgacggttgaggacttnnncagggccctcagatggagcanngagtaggctgt

SEQ ID NO: 1066 - DNA, 300 bp, Homo sapiens
aattccgttgctgtcgccaaggtggatgtagaagcgggctccggcgtcccactctcccttccatatgggcttagcgtctgggtcactgagaacgacgtctgaatagggccctgggtccttgccatggatgaatgtggttcccgcatccgccggcgggtgtctctccccaaaaggaaccgtccaagcttggggtgtatttttggcgctcccaccgtggtcgagctcgagcccggagatgaggggaaagaggaggaggaaatggtggctgatgaacaggagctggaaaaccgcgggcgtact

SEQ ID NO: 1067 - DNA, 300 bp, Homo sapiens
aattccgttgctgtcgcagaacacctaggtcctagcataagccccacctcctccaggaagccacctgactccctccagcaacagctctgcactttacctttgtattctctcctttctgactatggtcagcagacttctaagacggcccccaaagattgccacctggtattcatgtgctcgtgttatctcctcctcttgaatgagctggacctagtgacttctagtgcacagaaatgtggtgaaagtgatgggataacaatttccagattaagttataatagacactgtgggctgggtgcg

SEQ ID NO: 1068 - DNA, 300 bp, Homo sapiens
aattccgttgctgtcggatcttggagagtttctcccaggctccttgtgaactgctccgctggtgtgggagaagccaaaggggcaaagctcaagacggtgtctccctggtgagggcagttacattggcataagttgtctagcataacttgtcatgccgaccccttttcaagatagcagcttcattcactgataatgtggcagtgttccccttcatcagtggaagacatgggatgtgttctaggggaatttatagtacttgacatgtatgagggaaattctactatcaattaagtacaagag

SEQ ID NO: 1069 - DNA, 300 bp, Homo sapiens
aattccgttgctgtcgggctgtacaaaaggtagacataatagtgagaagccacctgagccagtcaaacctgaagtcaagactactgagaagaaggagctatgtgaattaaaacccaaatttcaggaacacatcattcaagcccctaagccagtagaagcaataaaaagaccaagcccagatgaaccaatgacaaatttggaattaaaaatatctgcctccctaaaacaagcacttgataaacttaaactgtcatcagggaatgaagaaaataagaaagaagaagacaatgatgaaattaa

SEQ ID NO: 1070 - DNA, 300 bp, Homo sapiens
aattccgttgctgtcgcacatacacacacatacacacaacacatacacacacacatacacacacatacacatacatacacacatacacacacacatacacatacacacatatacacgctcacagacacatgagtgaatctacatggaatatcccttgaataaaatgcaagcaattggttatagtgattgccactggggcagggaactaggaacttgatagtaaggcttggcagaaaaattactccttatcatacacagtttttggtattgtttgagatttttaaaataccatacatgtat

SEQ ID NO: 1071 - DNA, 300 bp, Homo sapiens
acttcgattgaattcccggagctgtcgatttagttatttgaagagaggttctcatttcctagaaaagatatgagaaacccaaatagaaaattattagagatctttgagacactctatttacattctggacctaatctttttgaattgtcttatatgagtgagtactttgtggcagaagatctagacattttaataaaacattttaatacaaatatctagatattttagatacatatttaagtatctaaaattcagacagccaggggtggtggccgtatacctgtattcctagctacttgg

SEQ ID NO: 1072 - DNA, 300 bp, Homo sapiens
aattccgttgctgtcgccgttgctgtcggaacattcttccctggaaccagtgctccacatctttcttttcctctgagagctgcagctggcagggacctccctctgctgctcctccagcaagccacagagcataccctcacgtgacaagagtgtggtaggttttctccccacttctcacacacgcctggtggttgtggttccatctgccttgttggcttgcccggggggattcaacacttgactttcaaatcaaagaatgctaatgcttagcacttgctgttgagcatgctctaactttta

SEQ ID NO: 1073 - DNA, 252 bp, Homo sapiens
  misc_feature (1)...(252): n = A,T,C or G
aattccgttgctgtcgagagaagcttttagtcaaaagtcagtttattaaatgtttagaatacctaaacaggaagaaaattctattgttttttataacaaagtggaagatttcaagaaaggacaactcactgtacacttgagaataatacctacagaggttcatactgaagagtagtctcaataatgtaaagaatttgacaagcatgatgctattgaaatagttctgtcngaagnggtgttnnttcttcnttt

SEQ ID NO: 1074 - DNA, 300 bp, Homo sapiens
aattccgttgctgtcggctcttgctgctgctcaggtagaacatctgggaggtcccttgctgaccactggaagaagatgagctcgagctattggagtgagacgagcagcagcagctgtggaacccagcagctcccagaggtgctgcagtgccagccccagcattaccactgctaccatcagtcaagccaagcccagcagcctccagaaaaaaatgtagtgtatgagcgagtgaggacctacagtgggcccatgaacaaggtggtgcaggccttggaccccttcaactcacgggaagtgctc

SEQ ID NO: 1075 - DNA, 300 bp, Homo sapiens
aattccgttgctgtcggaaagagcaaaaatccagcaacaattggccaaaatacataataatgtaaagaaacttcagcatcaattaaaagatgtgaagcctacacctgattttgttgagaagctcagagaaatgatggaagaaattgaaaatgcaattaacacttttaaagaagagcagagatatgaagagctaattaaagaagagaagacaactaataatgagttgagtgccatatcaagaaaaattgacacatgggctttgggtaattcagaaacagagaaagctttcagagcaatctc

SEQ ID NO: 1076 - DNA, 291 bp, Homo sapiens
aattccgttgctgtcgaaggatataagtttataatactgctatttttgattcccttgcctaagaaaaattaggtatgaataaaaatttaatttgaactgatatcacttcccttaccattcacatgttaactaattgataagataaaaatgtgttgtagtagaatagactagatcgtatgcctttttagatgaaaattatagaagatatttagtcatagtaactacaaaggcaaaataaatatcacagcaaaaccagtaataggaatgcttgcagactttttttttttttgg

SEQ ID NO: 1077 - DNA, 300 bp, Homo sapiens
aattccgttgctgtcgggaagataggcaatgccatttttttcaaatgtacacatacacacacacaataagaaatgtatttaataatacattttaccttattttcaaggcttatcatgacagtaactattctttaaataataagaaggaggaaggtaatattatgaattactaccaccaacagaaaataatgctgttgattacccattaaaatggtacagtagtatcattgtctgttggacatatagatcagtttttttcttctaaatgctatttcaactctctattattaacatatatat

SEQ ID NO: 1078 - DNA, 300 bp, Homo sapiens
aatgggtattgtcttagtctgtttgtgctactgtaaaaaatatctgagaccgggtaatttataaagagtaaatttctttttcacagttctggaggatgggaggttcacgatcaagatgctgccaggttcggtgtctggtcagggccaggcttctgcttccaggatggcaccttgcatgctgtctgttcacatggtggaagggcaaaaagggggcctagcttgctttctgcaggcctcttataagagcactcaaccatttgtgatggcagagcctgtgtggcctcatcaccttccaaagcc

SEQ ID NO: 1079 - DNA, 300 bp, Homo sapiens
aattccgttgctgtcggaaactccctggagcgacgcagcgtccggatgaagcggccttcctcggtcaagtcgctgcgctccgagcgtctgatccgtacctcgctggacctggagttagacctgcaggcgacaagaacctggcacagccaattgacccaggagatctcggtgctgaaggagctcaaggagcagctggaacaagccaagagccacggggagaaggagctgccacagtggttgcgtgaggacgagcgtttccgcctgctgctgaggatgctggagaagcggcagatggaccga

SEQ ID NO: 1080 - DNA, 300 bp, Homo sapiens
aattccgttgctgtcggtaaacttaaggcataaacttctgaaaattagttatgtataattttattcaatctaatgtacattttaaatatggataattgatagttttttctacaaataaaaatgtactatatatttagttacataaatactgttcattaactttgaattgagaaaatggataccatttgcattgctattgtggctttaattctgtgggttcagatggctattaaaattacatcttttaattgtgtttatttttaaagttgaaaagtgatcattatcctcctgttcattttg

SEQ ID NO: 1081 - DNA, 300 bp, Homo sapiens
aattccgttgctgtcgggattattatgctactttattaatgtttattgttattctttagaaagtaaattattgtaggcttataaaattaagaaatctagtttttagtaacataatcatttgctccctttaaattttaaatcactctaaatctgaacataatagctaacttaaaataagtagcatttggattacattatttttgcagataactgattatctgtgtgaaatgatttagtattataaatgttttgtgataaagtttatggtaaagattgattatagttacctcatttttatct

SEQ ID NO: 1082 - DNA, 300 bp, Homo sapiens
aattccgttgctgtcgctggaattttctttactcctgtatctgatgtctgggctgcgatgactcaaaggctgatttcagctgagactgtagaccacgtgcctacttgtggcctccccttttgccttgggtttctcacagaatgtggctggttctggagaatgagacttccaatgaaatcaggtggaaatgacatctcgccgctttcagcatgctctattggttggaacagttatggacttagctagattcaaaggaagggaacaaagaccccctcctctcagagagtggggcataatgag

SEQ ID NO: 1083 - DNA, 300 bp, Homo sapiens
aattccgttgctgtcgggacaaaaccacagcaagctgtcaggtttctgagtgaactgcttacttttccataattgatagataatacagccatgtctttaagagaactcttacagagtttattattatatatggcaatattaatagagaaaaatatttcatgtgatttttagagaacttaagcatttgccttaaatgtttcttaagccctagaaatatagctataatttcattatttatcctctcttaaacagatgattccctggtaaagagaagaaaaacactgtataaagtacagctgt

SEQ ID NO: 1084 - DNA, 300 bp, Homo sapiens
aattccgttgctgtcggaaagaaatcatttaaatgtactatatgtggcacaggctgtatcgagacctaccaaatcactagacatcgaaacattcatctttggtgaaaccacacaaatggattgtgtgtgccaaggccaacaagtcaaaatatgttgaacctaatgatatgatgtgtataaagggtgcaaggacacgtggaaatgatctgtaatattcgggttattaaaaatgtaattggctgggcgcagtggctcacacctgtaatcctagcactttgggaggttgaggcaggtggatca

SEQ ID NO: 1085 - DNA, 293 bp, Homo sapiens
  misc_feature (1)...(293): n = A,T,C or G
aattccgttgctgtcgggagagacaacgagaggaagaaaggagaaaagacatagaaagacgagaggcagcaaaacaggaacttgaacgacaacgtcgcttagaatgggagagaattcggcgacaggagcttctcaatcaaaagaatagagaacaagaagaaattgtcaggttaaactctaaaaagaagaatcttcatcttgagttggaagcactgaatggcaaacatcagcagatctcaggcagacttcaggatgtccgactcaaaaagcaaactcanaagactgactggaag

SEQ ID NO: 1086 - DNA, 300 bp, Homo sapiens
aattccgttgctgtcggccaactgttttatgtacttgagaagcaggtgttaacttcctcagttacaaatgagaaaacccaggcttaaggggattgactcatttgccaatagtcatgcagttaattgcgtttgttttgccacacagccactgttctttacatagcaatttggtatatagagaaaatatggtgccatggtcaagggcacgactttgaggatggactgtctggcttcaaaaatctgatttccatcccttacttattatgtaactttggccaaattactgaatgtcttaaccct

SEQ ID NO: 1087 - DNA, 300 bp, Homo sapiens
aattccgttgctgtcgcagagacttgctgaaggattaaaaggattttctcttttggaaaagcttgactgatttcacacttatctatagtatgctttttgtggtgtcctgctgaatttaaatatttatgtgtttttcctgttaggttgattttttttggaatcaatatgcaatgttaaacacttttttaatgtaatcatttgcattggttaggaattcagaattccgccggctctattactggtcaagtacatcttttctcttaaaattatttagcctccattattacaaaaaattataaa

SEQ ID NO: 1088 - DNA, 282 bp, Homo sapiens
  misc_feature (1)...(282): n = A,T,C or G
aattccgttgctgtcggctggagtaaaccgtgatcgagttactgcactccagcctgggtgacaagagtgagactctgtctccaaaaaaaaaaaaancngnatngccnggntttactcnggncncannntgcagnccnagttntgcngctntgctgttngttcngntttcntccannnatnggcntcaccntttggnnccaaaanggctgntgcnttccaggcttnanntccanactcaaacccanaaaanctgcccatccntacctgggngaccctttgtag

SEQ ID NO: 1089 - DNA, 300 bp, Homo sapiens
aattccgttgctgtcgcttctctgcccctaaatttggatatccatttcgagatttagaatccaaacgcttttattggagaaccattaaattaagaataaagttctaaatcagtttctccaattagttctattatattctatagtatatatactgtaattttgcatccccacgtgtgtcctaataaagatacctatagctgaacagtttgtagcatggaataaataaaaaccaaatgattcgtgttataaaatactaacatcctttgtaaaaacacaaaaatcttgtacctatatatatat

SEQ ID NO: 1090 - DNA, 300 bp, Homo sapiens
aattccgttgctgtcgcttcaaacctaaaaatcaagttatttccttttataatacttttcttccccatggaacaaatgggatcaatttgtgagttttttcctttaatgataactaaaatccctctaatttctcatttatgcttttgtcttttttatgaaatatttcttttaaaagccccaggcttcacctacgaaatatgaagagcaaaagctgattttgcttacttgctaaactgttgggaaagctctgtagagcatggttccagtgaggccaagattgaaatttgatactaaaaaggc

SEQ ID NO: 1091 - DNA, 300 bp, Homo sapiens
aattccgttgctgtcggatgcctgctctaagctgcaggagcagaagaagtcactcaccaaggagaaggaggagctggagctgctgaaggaggatgtgcaggactacagcgaggacttgcaggagatcaagaaggaactttcaaagactggtgaagaaaaatacgtggaagaatctaaagccagcaagagattgacaaaaagggtgcagcaaatgatcgggcagatcgatggcttgatctcgcagctggagatggaccagcaggctggcaagctggccccggccaacggcatgcccacggg

SEQ ID NO: 1092 - DNA, 300 bp, Homo sapiens
aattccgttgctgtcgggtttttaagaagtcgttaaacttaatatttactagatatttgtttttggatggcatctaatatattaatagcccagaaaaaaggcgccactaatgaatatgtcttggattacatagtgacatatattagcttttcgtccacatttgataacattgctaatattttctttttttttactgaagctctttgaatttaaagttttctctcatttaaatttattaattaaaaacatacctttactctgttccctttagcatttcaacctgatgttaaaagatgtgta

SEQ ID NO: 1093 - DNA, 300 bp, Homo sapiens
aattccgttgctgtcgcattaaagtcactaagaataaccattttttccagtatatatggaatatacaccaaaaaagaccttatcctggaccatagatacattttaacaaattcccaaagatttatattttcagagactgttttctgaataataataataaattagaagtaaaaaaaattggaaaattcctaattatttggaacttaaacatcatgtttgtaaatatccctgagtgaaaataggtctaacaaaaaatctactaaaataagtctaataaataaatttagaacatattttgaa

SEQ ID NO: 1094 - DNA, 300 bp, Homo sapiens
ggcacaatttgaagcccaacctcagattctaagtcccatatattagtttttggtaacaatcatcagtaaaggagaatattttaaaaacctataaaggagtccttgacaatactatctaaatctttttatacattgataattttataatataccctgtatatattaggtaaatgcctgtaggtctccaaagacctagaattgagaatcagagggtaaacatccaaacaaatcccctagatgtgggaaaataaggaagttatcttatttcgtcgtcatttatattgaggtgaatcatgatgg

SEQ ID NO: 1095 - DNA, 300 bp, Homo sapiens
aattccgttgctgtcgcacagctcttggtctccagacctgatgaggaaaatataagttcctatttacagctcatagacaagtgtctaattcatgaggcatttacagagacacagaaaaaaagattgttgtcatggaaacagcaggtgcagaagctctttcggtctttccctcggaaaacccttctagacatatcaggatatcgacagcaaagaaatcgaggctttgggcaatccaactccctcccgacggctggctctgtgggcggtggcatgggcagacggaacccgcgccagtaccag

SEQ ID NO: 1096 - DNA, 300 bp, Homo sapiens
aattccgttgctgtcgggaaattcagttacataaataaattacccaagttacatacctatatactgatagatttcaagtcatgttccagaaatcatgtttctaactagtatgctacactgcctgtctcgaaaaaaaaaaaatagtaactatgctctacactacgcagtccacttactatcccagttccttattctcctttgctgcaaaatgtcttgaaagagttatttatgcctgctgtctgcagttaagccatttcagggggatggagggcgcacaaccttatttgaagtgggttgagg

SEQ ID NO: 1097 - DNA, 300 bp, Homo sapiens
aattccgttgctgtcgcacagtttaaaaaagaaattagtttctcctaatgtgcacattaaaagtagtaaaaatggccaattttgttaaatcttgatccttgagtacatttttgtgtgtgtgcattttttccttgtaaaaataatccatgggagggcatggtggctcatgcctgtaatcccagcactttgggaggccgagggaggtgggtggatcacctgaggtcaggagtttgagaccagcctagccaacatggtggaaccccgtctctactaaaaatacaaaaattagccggcagtggt

SEQ ID NO: 1098 - DNA, 270 bp, Homo sapiens
  misc_feature (1)...(270): n = A,T,C or G
aattccgttgctgtcgcttcccttccttccccttccatctttctttccacatgtcctttccttattggctcttttacctcctacttttctcactccctatcagggatattttggggggggatggtaaagggaanccncnncanannccctggaactnngttntnncngnctcncncaannggnnccntngcnacccnngtacntcnaccctannaanncnntacagtngaaancaacccnnnccncnnanccncccnncncncnncnana

SEQ ID NO: 1099 - DNA, 300 bp, Homo sapiens
aattccgttgctgtcgctcattccaaggctatgcatatggatgtcacattcccatgtcaatcatctctggaaggtattattcgcccagttttttaagcatgggaaactgaggcttagagtcttaaaaaataagtagctggcagtctctcagcaaataatgatggtgctgcactacagacccagatctgtgactccaaagtcagcctttgttcttttcttcttgttacttttaattggaaaaaaatttaaattgcaaaaagttgtagagtgataaaaacaaaaatccacgaatgctcttct

SEQ ID NO: 1100 - DNA, 300 bp, Homo sapiens
aattccgttgctgtcgcagaataagcctatcaaacataggtcaaatggttaaataaagaatgaaagcgtaaaagccatagaagaatttttctgttgtcttggagtagagagaccttcctaagtttgacacaaatcccagaagctataacataaaagactgatacatttgacaacatcaaaatgagatccacttcataagagtaacactgtaaacaaagtcaaaagatacatgataatctgagaaaaataatttggaaaaaatatgataaaaggagttaattttcttaatatactaagagc

SEQ ID NO: 1101 - DNA, 300 bp, Homo sapiens
aattccgttgctgtcgtcctcctttatgagaaaagaatagaccctgatagatgaagctataaagttctataacatatcttcattgaacgtgtgattttttttaaagtataaatagcatattcatatttttgcaaattgcttgttttcagtacgcagcgttttgagagctgtgtatgttaatgcagttgactcccgaacagtgggtttgaattgctcaggcccacttatacctagcttttattcaaccaaacacataatggccagcatatatgaggagctaacttttcatatgtgtggtct

SEQ ID NO: 1102 - DNA, 300 bp, Homo sapiens
aattccgttgctgtcgcacaaaacaaacaaaaacccctgattcctggagatcctgattccataggtgtggtctctgcaagcaattttatctggaattgaagaccactggtgttctgggacaaaggttttgaaacagacaggggtccaaattctggctctaccacttattgaggtgtataaatttgaggaagttactaaatgctctgaacttcagtttctcctggaaaatgggataattatgtctagcttgtgtggctattgttaggatgaaatgagatacaagtatgtagagtacctagc

SEQ ID NO: 1103 - DNA, 300 bp, Homo sapiens
aattccgttgctgtcgcttgtttgcaatagctatcttcccactctcacttgaacccactccaaccaggcctccccatctccatgaacctgatcttgtcagagtcacaaggacctccacgatctccacattgctaaccaaatggtcaatgttcagtcttcatcttattcagctcatcagcagtccataacttcctcttccttgatgcatattcttcacctagcttccaaaacctatacttctcctggcttttctctgccttaccagtaatgccttactggtctcgttgctggctccttctc

SEQ ID NO: 1104 - DNA, 282 bp, Homo sapiens
  misc_feature (1)...(282): n = A,T,C or G
aattccgttgctgtcgcataccagctcctaagccctattaagaagaggcctggtcctctaatgccttggttccatttcagttgttctttgagagacagaatgatgtactaaccattcgtgattattagagatagggatgggtcagggctnagntanntgncngncttnttgtggntgggtggnncnttgancnnatctnagngctgtntgtgnnngtacnnnntnggtggttaatntatccatgctgcnanggctgtcanggantngntaagcgaatttcta

SEQ ID NO: 1105 - DNA, 300 bp, Homo sapiens
aattccgttgctgtcgctcagggcacagcaggcagtgtgttagccttggtctcccttgccctccaagtcccacagggcaatactggcaggcccaggaaagtgttacacactgcaggtttgcatgacggctaaggaaccacaatcttagggagatactatctctgtcttctaaggccatttgctgtacaaaaatccttgaaatacctgggcacagtggcacacctataatcctagcactttgggaggctgaggcaggcggatcacctgaggttgggagttccagaccagcctgaccaacat

SEQ ID NO: 1106 - DNA, 300 bp, Homo sapiens
cctaacttcgaaacccgctacttgttctttttgcaggatcccatcgactgggagcccggctcactcccggaggcctctgcctgcggctgacctgatccccaagggactgtcctttcctctcctaccccaccccactcccagacagagcagaagtatttttataagcagagaattttttatgtcttaccagatagagttgcagggaagggggggcctgctggggagtggggtttggggggccctctcccaggacactgcctcttctgggcagaaggcccctccagggggactgctccaaca

SEQ ID NO: 1107 - DNA, 300 bp, Homo sapiens
aattccgttgctgtcggtcgattcatatctgtaggattaataaatgggtctgttatatccgttttactgatggtgaaatgaaggaccagagagagtaagtggcctttccaaggcttcacagcaagcttgtggaagaaaccaccaagaaaccagctcttgagacttccagcatttgttccagttcctctgcaagggaaacccccattccctgctctctctttttcccctcctcacaggcagcaggtatgtgcacagacaggcctggagctgggctagggtaggagtcccctgtgaggctcc

SEQ ID NO: 1108 - DNA, 300 bp, Homo sapiens
aattccgttgctgtcggaaggagagttaaaagtcaataagcattacaaaaattgccattttgacatcagcaaatcaaatttctctatctaattaaaggaaaaccctttctcttatttctcttctcttttcctcttctcttcctcctcctctatttcccctctccttatccccttgtctccctcttctgctctttctctacttcctctttctctttttttgatatatttctatcatatattttcagaaataattcagtggcatctcatgtagatgtaccactttcttattgcaactcagag

SEQ ID NO: 1109 - DNA, 300 bp, Homo sapiens
aattccgttgctgtcgcaacccttactcctccggccaaggagccaatgtgagcattcagctggcagctaagaatgtgtatcccaataaacagggcagacctacagacccactggacccactagagatggacttgggccacagtgccttccatgacttcagtaaacagaggggtgtggtgatcttgtcaaagtcctggcgtcaatgtcagtgtccggctacacaccatgttcccgtcctcgaaaagcctctctgtacccctctatgttggtgacacaaccctggcaaatggccacagactc

SEQ ID NO: 1110 - DNA, 292 bp, Homo sapiens
aattccgttgctgtcgggcagaagctgtgtcctcagtactccgtgatgacgagtgagcctctgtgaaatggacaggtgggaaaacagctacctgctggcctgcccaggcacccgccacgggcccacgctgctcagcttctcaatgtgagactgtccacacctgcgaggtgtgctaaaggtgcaggttaggtggactgaccccaggacctccctgacccccaaccaggccagcggaagcctgccacctcctatgtgcggaccacacccagcattggcctagggggcggattgt

SEQ ID NO: 1111 - DNA, 300 bp, Homo sapiens
aattccgttgctgtcgctaatttgtggtacgatattgcttattgtgactttggcatgtatttttgctagcaaaatgctgtaagatttataccattgatcttttttgctatatttgtatacagtacagtaagcacaattggcactgtacatctaaaaatattacagtagaatctgagtgtaatatgtgtaaccaaaatgagaaagaatacaagaaatgtttctggagctagttatgtctcacaattttgtagaatcttacagcatctttgataaacttctcagtgaaaatgttggctaggc

SEQ ID NO: 1112 - DNA, 300 bp, Homo sapiens
aattccgttgctgtcgtacaaaaaaaattttaattagctgggtgtggtggcacatgcctatggtcccagctacttgggaggctgaggtgggaggatcactggagcccgaaagttcaagcccacagtgatccatgattgcaccactgccctccaggcctgggcaacagagtgagaccctgtctctaaaaaagaagaaatgattgaaatcatatttttcaggctggacttccaataaagtagcccttaaaaggatcattcttaaaatattagccatatacaatggtcataataaatgtatgt

SEQ ID NO: 1113 - DNA, 300 bp, Homo sapiens
aattccgttgctgtcgcatatcagtaaagaagtaaacaagaataaaatacatgctaaaatgtcatacactctttttgttctaacattttgatttggcagagccaatacccacctatactacaactttcttatgccagcacaagaatgctatattcaaaatgctttccatgtattaccttcttttatcctcagatatccttggcagatagtagggcagatattaccctcatcttattgaagaatattctgggtataaggaagtcaaataacttgtcaacagttacaaggttatgaggtaaa

SEQ ID NO: 1114 - DNA, 300 bp, Homo sapiens
accattgaatacccgctacttgttctttttgcaggatcccatcgatctgaaagcgggcagcactgtcattcatagccaaacagtcctattgagaggtcttggactatcaggccagctgtcagaccactccatgcactgggtgtgctctgttggtcagggactgggagggaaactacctctccttcccttaaccaagcatgaattatgtttgttagcaaacctctctgggaatatatgtcaagccacattcctcctggggcagctgcaacttcagggcttcacaataaacagttctgaaaa

SEQ ID NO: 1115 - DNA, 300 bp, Homo sapiens
ggcacacatggcccaccatgcagggccacacaaagaagcaccggggttggtcaggaggccgagggaacctttattgtcgattccaagagaaagaatgggtgagagagagtagtatgaataagtgtagtgggatctgggagggaggagctgtccctaattatctggtgtctgcccggggattggttaagtcaggggacagggaccaggacatgagagcctgaaggacctggttggggtgtgagctttaggtgcgttgctttgcatacgaaaggtacctggaagatgagttgtttgtcctct

SEQ ID NO: 1116 - DNA, 291 bp, Homo sapiens
  misc_feature (1)...(291): n = A,T,C or G
catgccgatgctgtccatgggtgccaagcaagccagttttttggttccctgagggaaactgaccctcctctcttgtggcaccatccagcctcagggtcttggagacttgagtaagaatgtgagtggagggggagngnatntcttaagggggnggaccccaannccctgaggaacatgcncttngnnaagaagncaanannnagggccttnanangangcatgcnanantgccnaggtcatgantgcnantgccgangtatgangnacnttntnanacnntgnnaggaggca

SEQ ID NO: 1117 - DNA, 300 bp, Homo sapiens
actctagaatacaagctacttgttctttttgcaggatcccatcgacagatcctggtaccccctgcccgcgccgatataatgctttttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatggtggctggaccctatccccccaactgc

SEQ ID NO: 1118 - DNA, 300 bp, Homo sapiens
aattccgttgctgtcggtcattcgcaccaagcaatacctctatgtggctgacctggcacggaaggacaagcgtgttctgcggaaaaagtaccagatctacttctggaacattgccaccattgctgtcttctatgcccttcctgtggtgcagctggtgatcacctaccagacggtggtgaatgtcacagggaatcaggacatctgctactacaacttcctctgcgcccacccactgggcaatctcagcgccttcaacaacatcctcagcaacctggggtacatcctgctggggctgctttt

SEQ ID NO: 1119 - DNA, 297 bp, Homo sapiens
  misc_feature (1)...(297): n = A,T,C or G
aattccgttgctgtcgttcaattgttctctcttcaagttcactgattctttttttcttcctgtctagatctgcctttcagtctctctagtggatttttaatttcatttattgtacttttcggcttcagaatttttgtgtgtatccttttaggttttcattctctgtgtttctcttactctgttgctttttttttttttttttgggggccnnnnttngnggnnaaggnggancnaaancncngggnnnaaannanncnnccnnnccaanttncnggggaacngggancngaattggcc

SEQ ID NO: 1120 - DNA, 300 bp, Homo sapiens
aattccgttgctgtcgccttgaatatgtaaaaatacctatcatatcagtgtaatactatcttaacaatcctaaaaaccaggaaagaaaagcaaaatacagccaaatcaatgtcaagaattcttgggaaggctgggtgcagtggctcctgcctgtattctcagcattctgggattacacttgagtccaggagtttgagaccagcgtgggcaacatggcaaaacctcatctctacaaaaggtacaagaaattagcaggcatggcggcgcgtgcctgtagttccagctatttgggaggctgag

SEQ ID NO: 1121 - DNA, 300 bp, Homo sapiens
gtggttctggaagaggacctggacattgctgtggattttttcagtttcctgagccaatccatccacctactggaggaggatgacagcctgtactgcatctctgcctggaatgaccaggggtatgaacacacggctgaggacccagcactactgtaccgtgtggagaccatgcctgggctgggctgggtgctcaggaggtccttgtacaaggaggagcttgagcccaagtggcctacaccggaaaagctctgggattgggacatgtggatgcggatgcctgaacaacgccggggccgagag

SEQ ID NO: 1122 - DNA, 300 bp, Homo sapiens
aattccgttgctgtcggccactgcgcacggcctggggaggttttatttcttgacaaaggtatttgatactcgtgcagtccctggagggtctcactggagagacaacatttaggctgagatctgattaacaggaggcagctgcagtgcagaggtcaaaagggagggtgttccaggcagagaaaacagcctgtgcaaaggccctgaggcagaaacaaactctacttgaggtcagcctggttagaaagcccaactcaaaatagaaagtattacatgataaggtctgaggcaggctggacccag

SEQ ID NO: 1123 - DNA, 283 bp, Homo sapiens
  misc_feature (1)...(283): n = A,T,C or G
aattccgttgctgtcgatgtgttccctacaaatctcatgttgaaacgtaatccccagtgttgttggaggtgaggcctggtgggaggtgattggctcatgggggcatatccctcataaatggcttggcgctgtccttgcaataatgagtgcattttcactctatgagttcacatggatttggctgcttaaaagtgtatggatttcttacctgctgttgctctcaccntgcgatgcnnntagttcccnctttgccttctgccttgngtaaaaactccttgaggcc

SEQ ID NO: 1124 - DNA, 300 bp, Homo sapiens
  misc_feature (1)...(300): n = A,T,C or G
gtgagagaattgtggagaccaactaccacatatcattgagcccagctcttgggagcattgagatgtatagctcagggttacacagttccaaatcttgggaaggggcttttcagacagactgtttgctttctgctgagataaggaatgcatcactctgccagagtatgactttttacaatgagacatatgcagctttatttaataatctgcatatgtctcattgtaaaagatgaanntgannnanacatgnaacaaacanngaaaanatnngnnnncngtnaaangttaacggaccatgca

SEQ ID NO: 1125 - DNA, 300 bp, Homo sapiens
  misc_feature (1)...(300): n = A,T,C or G
aattccgttgctgtcgctgacttgcttgagagttctgtcagacttttctttttaaaaatttaacatgattgcttttctcaattttggagaagatgtttaaatagttctgttgtaacttttaatagttttgtgtatcattcaactttttttcttgcagcaccgaggcacatttgaaaagatggaacngaagtcnngntggttaccgctgggngaatataannagcantttcagctgtgcggtaatggcnnantnngnnncttanctctgcgnngtctngctctagagatacnacttttgac

SEQ ID NO: 1126 - DNA, 300 bp, Homo sapiens
  misc_feature (1)...(300): n = A,T,C or G
aagttgtggcaaaggaaactatacttttcatttttaaaaatgtaaatagaaaagtttttaacgggcatatnggncaaaagnatacgttttaacgatttttaangatcaaaatgtggcacngctggtacnttttatcttgctgactgcncncatatttntnnagcanncttnctgtncnnagnatgacttnaccggctctntaactangatatacttcngggggganaaagctgtgatactatagctaataaatncccactanagngacactgaagatttaaacacaagcattcataagat

SEQ ID NO: 1127 - DNA, 300 bp, Homo sapiens
aattccgttgctgtcgagcccaggtcccagcggaatgggcctctctgttcagtaggatccccctcctgctgagtggttcatggcatgtttctgttcaacgcttttccatctgtaggattcttattctgtatttatttgtttttttgggtttttttattttttgagatggagtctcgctctgtcgcccaggctggagtgcagtggcacgaccccagctcgctgcagcctctgcctcccaggacgagggagatcctcccacctcagccttccacgtagctgggactacaggcatgcaccaca

SEQ ID NO: 1128 - DNA, 300 bp, Homo sapiens
gccctgtttgcctataagatgtcatcggtgcagatgatgtttggggtcaatttcttctcctgcctcttcacagtgggctcactgctagaacagggggccctactggagggaacccgcttcatggggcgacacagtgagtttgctgcccatgccctgctactctccatctgctccgcatgtggccagctcttcatcttttacaccattgggcagtttggggctgccgtcttcaccatcatcatgaccctccgccaggcctttgccatccttctttcctgccttctctatggccacactgtc

SEQ ID NO: 1129 - DNA, 261 bp, Homo sapiens
  misc_feature (1)...(261): n = A,T,C or G
aattccgttgctgtcgatgaaattcagtataaaattgaatagaagtaatgttaatggataatcttgtcttattcctggtctcagagaggaagtttttaaatatttaatatgacatacattgtttgattgggactantcagcaaaatcctttatcagatttattaagctccctttgtttnttaatttattatgttcnttnnatttntgantntgnatngantttatcncanatattctgttaatnannngttntttncnnna

SEQ ID NO: 1130 - DNA, 300 bp, Homo sapiens
aattccgttgctgtcgagaaatggaagaacgtgaaaaaagaaagataattgctgaagaaaagcacaaggaatgggttcagaaaaagaatgagcaaaaaagaaaagaaagagaacaaaaaattaataaagaaatggaggaaaaagcagcaaaggaactggagaaagaatacttgcaagaaaaagcaaaagaaaaatatcaagaatggttaaagaaaaaaaatgctgaagaatgtgagaggaagaagaaagaaaaggaaaaagaaaaacaacagcaagctgaaatacaggagaaaaaggaaa

SEQ ID NO: 1131 - DNA, 256 bp, Homo sapiens
  misc_feature (1)...(256): n = A,T,C or G
aattccgttgctgtcgagctgcaccatcactgcgtatccctgtgactcctaccaggattataggaatggcaagtgtgtcagctgcgggacgtcacaaaaagagtcctgtcccgnttctggnctattatgatncagttgnnaagncngttcagccnnaagtgcctaatgagnnngcnancncncattaaatgcnttgcgctnnctgcncagctnagcaagcngntaacntgacntgccanctgtatnaatgaancng

SEQ ID NO: 1132 - DNA, 300 bp, Homo sapiens
aattccgttgctgtcgacacattcgggctttagaaaaggaggaagaagaagaaaaacagaagagtttgctgagagaaaggagacgacagcgaaaaaatagggaatctttccagatatttttagatgaattacatgaacatggacaactgcattctatgtcatcttggatggaattgtatccaactattagttctgatattagattcactaatatgcttggtcagcctggatcaactgcacttgatcttttcaagttttatgttgaggatcttaaagcacgttatcatgacgagaagaaga

SEQ ID NO: 1133 - DNA, 265 bp, Homo sapiens
  misc_feature (1)...(265): n = A,T,C or G
aattccgttgctgtcgcaaggtggtacctctatgaggctgcaagaaccacaacgtagatacagtttagatggtaatacccaagtcctttaaaatatttggaangcccaanaaggatggaatncanataatnctcanatagtgaananaancagtnnannnnntncnntantatatnttntgnnattctttntngcaacnnnttcnctctttncntnnatagnaaantnnctatangntttnngttnntnatannnnntaatnatt

SEQ ID NO: 1134 - DNA, 293 bp, Homo sapiens
  misc_feature (1)...(293): n = A,T,C or G
aattccgttgctgtcgctttgcaacctacctgaccctggcttgctgttctggacccaggaggcatttcccctggaacctgattctcctgaccgtctttaccctgtccatggcctacctcactgggatgctgtccagctactacaacaccacctccgtgctgctgtgcctgggcatcacggccttgctgctctcagtcaccgcttcagcttcagaccaagttcgacttcacctcctgccagggcgggcttttcgggtttttnatgnattttttctttnanggaattnatctggc

SEQ ID NO: 1135 - DNA, 300 bp, Homo sapiens
  misc_feature (1)...(300): n = A,T,C or G
ttgaaccccccaatagagctcttgtcttttgtttgaacccntgattcgaattccgttgctgtcgctagccacatcaccaaataagtgaacaaacaacagcgacaaatcctggagtagagagtatcgttatccagagctgcagcagtgtagtacctaaaatgttcagtgcagtaaaaatgagacatgcaaagaaataggaacatgtgattcatacacaggaaaaaagactagaaattaccttgataaggaccagatgttgatcttagtgaacaatgacttcaaagcagctattataagtat

SEQ ID NO: 1136 - DNA, 300 bp, Homo sapiens
aattccgttgctgtcgaaagaagtatgactgttagtacttctcaggacccatctttctcaggattaaaccaggtctgaaactgtctcctattccaacctcaatcccaaattcatgtgcttttcttttttattgttttattttgatgatttttgttttgttttaattctggagaatgtagatcttgctcaagcacctcttacgttggcattattcagacatacttggcaaacataacattactaagatatttctttgtggcttttgcttaaaacttataaagtttagaaaaaagctaaatg

SEQ ID NO: 1137 - DNA, 300 bp, Homo sapiens
aattccgttgctgtcggtttctccgtgttgcccaggctggtcttgaactcctgggctcaagcaatccgtccgctttggcctccgaaagtgctgggattttaaaggcgtaagccactgcacccggtaactttgggttcttgaattcccttcctcctcttcttcctcctcccctacactccattagagaaagggtcttgctttgttgcccaagctggagtgcggtggttgttcacaggcatgatgatcactgcagcctgggctccagtggtccgcatacctcagcctgccagtagcaatttg

SEQ ID NO: 1138 - DNA, 300 bp, Homo sapiens
aattccgttgctgtcggggaagtccaagattgaggggccagatctggcaagggcttccttgctgcatcatcacatggcagaaggcatcatatagcaagagagcaggcaggagatggatggcaatgggggccaaacgcgcttttataacaaacccactcccttcataaaggacagtccatttatgagggcagagcccccatgacctaaacatctcccattgggcccatctcccatcactgttgcattggagattaagtttccaatacatgaattttgggtgacacactcaaatgatagtat

SEQ ID NO: 1139 - DNA, 293 bp, Homo sapiens
  misc_feature (1)...(293): n = A,T,C or G
aattccgttgctgtcgggaatgaagatgatgacgcctccttcaaaattaagactgtggcccaaaagaagggngaanngaatgancgcgagagaaanaaagcnagatgaagaanaagcgaanctgnggaagctgaaanaactnagacgagttagaancnggtnanaaggatcagagtaaacnaaaggaatctcaaaggaaatttgaagannaaactgtntaatccanagtgactgttgatactggagtaattcctgcctctgaananaaagcnnanactcccacagntgcacaa

SEQ ID NO: 1140 - DNA, 300 bp, Homo sapiens
aattccgttgctgtcggcttgaagtatggaaaaactgggcccagaccaagaatgctgaactagagaaggatgctcagaacagattggcacccattgggaggcgccaactgctgcgattccaggaagatctcatctcctctgctgtggcagagttgaattatgggctctgtctaatgacacgggaagctcgaaatggagaaggtgaaccctatgacccagatgtgctctactatattttcctgtgtattcaaaagtatctttttgaaaatggaagggtagatgacattttctccgatcttt

SEQ ID NO: 1141 - DNA, 291 bp, Homo sapiens
  misc_feature (1)...(291): n = A,T,C or G
aattccgttgctgtcggtggtggcgcgcacctgtagtcccagctacttgggagactgaggcaggagaatcgcttgaacccaggaggcagaggttgtggtgagcggaaatcatgccattgcactccagcctgggtgacagagcaagattctgtctcaaaataaatacatacatacatacatacatacattcatacatacatacaactttgttttttcttttctttctttttttttttttnaanggnaaangcaccaccantnaaaaaaccnttaccgaaanggnaaaaaaaa

SEQ ID NO: 1142 - DNA, 300 bp, Homo sapiens
aattccgttgctgtcgggcagtggtttcttagatgttgacaccaaaagcacacgtggcaaaagaaaaagcaaagtcaacaccatcaaagatgaaagtgttcgtgcttcagggaacactatcaagaaagtgaaaagacaacccaagaatgggatagtattttgcaaatcacatatctgttaagaatcttgtatctattctagctataggactcttacaacttaataaaagagaaaacccacctgggtgcactggctcacgcctgtaatcccagcactttgggaggccaggcggacggatca

SEQ ID NO: 1143 - DNA, 300 bp, Homo sapiens
aattccgttgctgtcggcaccttcgtgtcccactactcgagccacctgaagcggcacatgcagacacacagcggagagaagccgttccgctgtggccgctgcccctacgcctcagcccagctcgtcaacctgacacgacatacccgcacccacactggcgagaagccctaccgctgtccccactgcccctttgcctgcagcagcctgggcaacctgaggcggcatcagcgtacccacgcagggccccccactcctcccactactcgagccacctgaagcggcacatgcagacacacagcg

SEQ ID NO: 1144 - DNA, 290 bp, Homo sapiens
  misc_feature (1)...(290): n = A,T,C or G
aattccgttgctgtcgccagtgagtacctgcaaaaatgagttgtcacagaaattatgatcctctatttcctgaacctggaaatgatgttggtccaaagtgcgtgtgtgtatgtgtgagtgggtgcgtggnatacatgtgtacntatatgnataanacnnatnnacnntanatctaacntatnancncnncctnctncntccccttcncacgnacngccntntnnnncctcagnatccncntcagcctncnccntnatgcatcncatgcccgctcagttnttncctccctc

SEQ ID NO: 1145 - DNA, 296 bp, Homo sapiens
aattccgttgctgtcgattgatagaactactttgaaaacaattcagtggtcttatttttgggtgatttttcaaaaaatgtagaattcattttgtagtaaagtagtttattttttttaatttcaagtgatgtaatttaaaacctaagttgtgtttcaaaacagcaccaaaactgtattgtattttttttgctgtaattaactgtataatgtaaacctaattattttatcatggtttaaattttttgcatatttgcttaatcttatgctgctgattcttctaactgaatttgcagatt

SEQ ID NO: 1146 - DNA, 300 bp, Homo sapiens
aattccgttgctgtcggtgaaagtgtactaaaggaagtataccaagcctttaatcccaaagcagtggtcttacagctgggagctgacacaatagctggggatcccatgtgctcctttaacatgactccagtgggaattggcaagtgtcttaagtacatccttcaatggcagttggcaacactcattttgggaggaggaggctataaccttgccaacacggctcgatgctggacatacttgaccggggtcatcctagggaaaacactatcctctgagatcccagatcatgagtttttcaca

SEQ ID NO: 1147 - DNA, 300 bp, Homo sapiens
aattccgttgctgtcggggaagttaagacttataatcacccatagctttcaaacagaacacacatagcatctccaccttcattaccaccatcaccaccaccaccacctccatctccacctgcaaccccagcactaccaccatgaccaccaccaccatcactgccatcaccatcattaccatcacctccacctctaccttcaacatcaccatcacaatgaccaccaccatcaccaccagaaacactgaataaaataatgaaagtgcagccttaggctgggcacggtggctcacacctgtaa

SEQ ID NO: 1148 - DNA, 285 bp, Homo sapiens
  misc_feature (1)...(285): n = A,T,C or G
aattccgttgctgtcgatgttggggctggcaaaacgagtcggtgcccgtctgctcctggcctccacatcggaggtgtatggagatcctgaagtccaccctcaaagtgaggattactggggccacgngaatccaataggacctnggtcctgctacgatgaaggcaaacgtgttttanannccatgtgctatncctncttgaantttanngcgttnatttnctannnttttnttanntttnanntnnnnatnncanntnnactnatnnntgnagnatntgtctttat

SEQ ID NO: 1149 - DNA, 280 bp, Homo sapiens
  misc_feature (1)...(280): n = A,T,C or G
cggccgcaggaatttttccagtcaaaagcatattcgagggactaaaaggacatcaagagggatacttcagtcaaatgataatcagctatgaaaaaataccttcttacagaaaaagtaaatctcttactccacatcaaagaattcataatacagagaaatcctatgtttgtaaggaatgtgggaaggcttgcagtcatggctcaaaacttgttcaacatgagagaactcatacagctgaaaaacactttgaatgtaaagaatgtgggaaganttatttaag

SEQ ID NO: 1150 - DNA, 300 bp, Homo sapiens
aattccgttgctgtcgcaagttttcacaagaggccgggcatggtggctcacgcctgtaaccccagcactttggctattgtttttttgtttttttaatttcttgtagatacgaggttttgctgtgttgcccaggctagtctcgaactaactcttggcctcaagtgatcctcctgcctcgggctcctgaagtgctggatatacagtcgtgagccactgtacctggccagaactcctcttctagggggaagtcaaccacaatgtaggaagtcagattgtcccaagtccactatgctgtaagga

SEQ ID NO: 1151 - DNA, 300 bp, Homo sapiens
aattccgttgctgtcggcaggggcctccccggtcgccccagcaggcccaggcacataggtgcccagagatccctggcttctgatcgcccggaagactaagagctttagttttggtccagaaagcattttcaaggagctggtcaagcatggctttagcagataagagacttgagaacttacagatctacaaagttcttcaatgtgtgcggaacaaagacaagaagcagatagagaagctgaccaagcttggataccctgaactaatcaattatacagaacccattaatgggcttagtgctt

SEQ ID NO: 1152 - DNA, 272 bp, Homo sapiens
  misc_feature (1)...(272): n = A,T,C or G
aattccgttgctgtcggagatgtggaatgaggctgagaagcaactgcagaacagcttgatggactttggagaaccgtggaaaatgaacccaggagatggagcattttatggccctaaaattgacataaaaatcaaggatgctattggcagataccatcaatgtgctacaattcagctggacttccaactgcctattagatttaatctcacatatgttagtaaggatggggatgataagaagagacctgtgatnattcnttcanctcattttt

SEQ ID NO: 1153 - DNA, 262 bp, Homo sapiens
  misc_feature (1)...(262): n = A,T,C or G
aattccgttgctgtcggctccgaggaggaagaagctaactattggaaagatctggcgatgacctacaaacagagggcagaaaatacgcaagaggaactccgagaattccaggagggaagccgagaatatgaagctgaattggagacgcagctgcaacaaattgaaaccaggaacagagacctcctgtccgaaaataaccgccttcgcatggagctggaaaccatcaaggagaagntngaagagcannctctgaaggntaccg

SEQ ID NO: 1154 - DNA, 272 bp, Homo sapiens
  misc_feature (1)...(272): n = A,T,C or G
aattccgttgctgtcggaaaggttatcaagacacagaacttggcagctctccttcatgcgattgccagacgtccaaaggggcagcaactagcatgggattttgtaagagaaaattggacccatcttctgaaaaaatttgacttgggctcatatgacataaggatgatcatctctggcacaacagctcacttttcttccnaggataanttgcngangtntatctatttttttgaaacntcttgaggctcnnngntnntaatntnnatattttt

SEQ ID NO: 1155 - DNA, 288 bp, Homo sapiens
  misc_feature (1)...(288): n = A,T,C or G
gctgcaataaacaagttaacaacaacaattgcattcattttatgtttcaggttcagggggaggtgtgggaggttaaccccnnccccccncnanccgccttncctncncaccnaccctaccacnccntccncctcctccccttctcgnncnnccccccctcctccnntattccccnccncntcccttnncccaatcnnccgnacttgncncncngccncannnnctcctcntccncncncnntcatctcntcacccccctncctctncnctaaccnccccctctccaat

SEQ ID NO: 1156 - DNA, 292 bp, Homo sapiens
  misc_feature (1)...(292): n = A,T,C or G
aattccgttgctgtcgtgcctccaagatggtgagtcttcttgcgtggtgagggtgggggttcgggtgcanantatnatanagtgaccntatnatacnntgangacnnccnagagactctcacnncancancagttccaggcnttcaaaccgaanacaatccannaaaagnggaacatacngaanaacnttctantataacnnaactantnactactnatagaaaatattcntgactaggtcccncanatccttctnacttccnatanaaanagagagntcttaacctttaaa

SEQ ID NO: 1157 - DNA, 262 bp, Homo sapiens
  misc_feature (1)...(262): n = A,T,C or G
aattccgttgctgtcgggcgctttcaactgtactgctgcagctttaagtaccttaaagcttctcctgtgaacttcttagggaaatgttaggttcagaactaaagtgttttgggtgggtcntatttcttnnaattntctatnnatnncnctntnananntaaanttaanttannaatctnncngttnttanttanaanatnnantnttntnatctccnngtantatannnttnntnncatatgtnnatannntaanntancga

SEQ ID NO: 1158 - DNA, 300 bp, Homo sapiens
  misc_feature (1)...(300): n = A,T,C or G
aattccgttgctgtcggtaggattataaatggtttaaaatacgtattctcaaacctcattttcagcatataaatttttaagaatcagtgtttaaaggtacgtgaaaccatttgctagatttttgtcctagttttttttttttaatttaaaaannttanntgttttttaganannttnnaatgnccntgcctcactggcnaaacgcnttcagngnnggatcnactgtttaagangatctccgggaanaagccctnanantttganagggactgnnntnggtgttcnatnctnccccagttt

SEQ ID NO: 1159 - DNA, 300 bp, Homo sapiens
aattccgttgctgtcgcacacagcccctctgcaaaggttgggaaacttgcaaggaatttaaggaaatctctgttcagtcattagccagccactaaactaactgagcagatccttcagtgatcacacacaacaaagaatacagactttacagacttagtcctagaaaatcactacacaaacagcaacaacaatgcacctgggactaagggagaggagatgagttccagagttggtatattatttaaatgtctagttttcaataaaaacaattataagacacagagcaaaactagaaagtat

SEQ ID NO: 1160 - DNA, 300 bp, Homo sapiens
  misc_feature (1)...(300): n = A,T,C or G
ctggtgttagggttctttgtttttggggtttggcagagatgtgtttaagtgctgtggccagaagcggggggaggtgtgggaggtttaantcnnccacnaccatattcnnaacnnngtttnanccnnttcttnncacnaancctatatttgancccancctntgnacnngncntncttgantcacntnacatgttanccctncnaccncctacncatancantncnttancntnantcnccnttacttnntncctnccaccctgnnncnnactnncccacnnttcagnccttattctctcc

SEQ ID NO: 1161 - DNA, 300 bp, Homo sapiens
aattccgttgctgtcgataaaatgggaatcttcttggtattttatgtgtattgtaagtagcagttaaattatttttttaaaagcaatttcagttttaatcactgaacaaaagaaacaggcaacattcacttctgtagtatggtttccacctatctctaacaccactattaaggtacaccagtgttaaggtacattaataactacacaaaattttatttaaagagaacacttagcagcctatgatagttttcaataaaatgttgcctctctttcggattctcactaacttttggtactatt

SEQ ID NO: 1162 - DNA, 291 bp, Homo sapiens
  misc_feature (1)...(291): n = A,T,C or G
aattccgttgctgtcgaagaacttcatgggcttcaataatgtctagaaagtaaaatgaaagaggaatgttaccatccccagctgcccttatttccagagaaccagacgtttggntgnnnagnggatnnanaancgctnnncntancaggntactcgatnaaggcaaggtaaatatngctncannagtgccctctncnttcncangagtccctcnnatnagcacccttatgntagggnntnnnnntnnnaacnttccngntngaccanannttnaccnctgnggccgttagg

SEQ ID NO: 1163 - DNA, 284 bp, Homo sapiens
  misc_feature (1)...(284): n = A,T,C or G
aattccgttgctgtcggttagaccaccatttacatatgcatctttaattaggcaggccattctcgaatctccagaaaagcagctaacactaaatgagatctataactggttcacacgaatgtttgcttacttccgacgcaacgcggccacgtggaagaatgcagtgcgtcataatcttagtcttcacaagtgttttgtgcgagtagaaaacgttaaaggggcagtatggacngtggntgaagtagaattcnaattaccanggtnacannagatctttggcaacc

SEQ ID NO: 1164 - DNA, 300 bp, Homo sapiens
aattccgttgctgtcggcaactgtgacctggagcgctttgctcaggtcttggagaaggaactgcccctgtatgcgcgccccatcttcctgcgcctcctgcctgagctgcacaaaacaggaacctacaagttccagaagacagagctacggaaggagggctttgacccggctattgtgaaagacccgctgttctatctagatgcccagaagggccgctacgtcccgctggaccaagaggcctacagccgcatccaggcaggcgaggagaagctgtgattccccccatccctctgagggccg

SEQ ID NO: 1165 - DNA, 300 bp, Homo sapiens
  misc_feature (1)...(300): n = A,T,C or G
tataagctgcaataaacaagttaacaacaacaattgcattcattttatgtttcaggttcagggggaggtgtgggaggttttacngacgctaaagaaaacccntatggcaagnatgactataanagnccattcccnctgcannccaaaaactaacgcagntatgccnagaatgngactgtctggntcnaacccagcgnnctgcanacngatgtacngaagattttatgaaatgcatnganactacctgaaaaatcacagacnttctataaggagctnaacngtttncganaggccgtctag

SEQ ID NO: 1166 - DNA, 294 bp, Homo sapiens
  misc_feature (1)...(294): n = A,T,C or G
aattccgttgctgtcgtaccccagtaccagtgaggatacattgggaattacttggcaaagtcctggtacctgggctagcttggttcctttccaagtgtcatatangacncnnatnttaccggccanantccnatantacggntngantatnttgtgntgcnganccattttcacaattactatgtnatnnantganaatgnttnagtnaaaaantncatanctgnaanacatngaatntnaattgggccatcatntacganttganctgaantatttagggnactttataaatt

SEQ ID NO: 1167 - DNA, 260 bp, Homo sapiens
  misc_feature (1)...(260): n = A,T,C or G
aatccgttgctgtcggaaacgctgccagatcatcatctttcaggtggtcttcctgggcctcctggctggcctggtggtcctcttctacgnctatcctgtgcgttgcnagnagttgtnnnttnnctnatggcnggtattctgtnttntttnnttttttttnntttnngnagccnnntgatnatgttttnnttngttnttntgnagnntnnnagttttggtaggtttntngtcngnttcnnagntnnattctntctantgnt

SEQ ID NO: 1168 - DNA, 293 bp, Homo sapiens
  misc_feature (1)...(293): n = A,T,C or G
aattccgttgctgtcggaagaagttgaagcagaagtgaaagcagctgcagagatatcaatgggaacagaggtttcagaagaagatatttgcaatattctgcatctttgcacccaggtgattgaaatctctgaatatcgaacccagctctatgaatatctacaaaatcgaatgatggccattgcacccaatgttacagtcatggttggggaattagttggagcacggcttattgctcatgcaggctctcttttaaatttggccaagcntgcagcttctaccgntcagattcttg

SEQ ID NO: 1169 - DNA, 300 bp, Homo sapiens
aattccgttgctgtcgatttaatatacaacttggtttagaataaatatctaacaaatgtataattgaatggcagagacactgacacttcatttgataggtcattgctcctgcccagtttgggactgagaaaataatttgatagttggtccaatgtgtgatacctatgaaagaaccgagcctttaatattttcatctttatgttacagccactgtgtcgaactcccagcaggcttaccaggaagcatttgaaattagtaagaaagaaatgcagcctacacacccaattcgtcttggtctgg

SEQ ID NO: 1170 - DNA, 292 bp, Homo sapiens
aattccgttgctgtcgccaagggctcactaagccagaggccaaagtgccccctcccgttcacctaccacccaagtcctcatgccctccgagggctgggggaggaggggctcaaggaaggggggttccatgtacatatttatcacccctttcacatagccccaagaccttttgtacatttttacaggggtgcccctcccaacagttcccttcctggttaattaaaccctcagactggtgctgtgttcctagcctctggcctctctgtggggaaaggggactgcaaggggaaga

SEQ ID NO: 1171 - DNA, 263 bp, Homo sapiens
  misc_feature (1)...(263): n = A,T,C or G
aattccgttgctgtcgggcacagtagtttaccctgttatctgtgtttcataatgggggctgtatgaatattatttataactaataaaatgttgccagaattatactaaactgttggatgagattaggagatcagaggctggaccttctcttgataatgcttgttttgttacagntattangaaatnntttgtatgtgattnntttnntnntcngnatngttnatgtnnagatnggtnanannnnctttttnantngctgaatt

SEQ ID NO: 1172 - DNA, 300 bp, Homo sapiens
aattccgttgctgtcgctctttctggtgactctctggattttgaaaaacagactctcctccctcaatagtgaagtgtccaccctccggaacacaaggatgctggcatttaaagcgacagctcagctgttcatcctgggctgcacgtggtgtctgggcatcttgcaggtgggtccggctgcccgggtcatggcctacctcttcaccatcatcaacagcctgcagggtgtcttcatcttcctggtgtactgcctcctcagccagcaggtccgggagcaatatgggaaatggtccaaagggat

SEQ ID NO: 1173 - DNA, 300 bp, Homo sapiens
tagatcaagctacttgttctttttgcaggatcccatcgagccggcgcgagtgtgcgtgtgtgtgcgtgtgtgtgtgcgagcgcggtggaggggggggaccaactgcttcacactttcaacactgcactgaagagggagagcgagagagagactggagacgcacagatccccccaaggtctcccaagcctaccgtcccacagattattgtacagagccccaaaaatcgaaacagaggaaacgaacagcagttgaacatggacgaaggaattcctcatttgcaagagagacagttactggaa

SEQ ID NO: 1174 - DNA, 299 bp, Homo sapiens
  misc_feature (1)...(299): n = A,T,C or G
aattccgttgctgtcgttgcacccaaggctgagcctgccatcatccctgccacccggaacgagcccatcgggctgaaggcctccgacttcctgcccgcngnganaatncnccnnnnngcnnatctggcntacaangatganatngacgtgataggtgntancannaacancatagananaaactgnttntntgtangnnganngtnntacntnatccgntncatnnaanntngaatncnnatcnnctccnannaggaaccgtcttgagaagatngcatganncgaatcctactcttcga

SEQ ID NO: 1175 - DNA, 294 bp, Homo sapiens
  misc_feature (1)...(294): n = A,T,C or G
aattccgttgctgtcggccgcgaggcggcaatgccggcttggggcttggagcaacgcccgcacgtggcagggaaacctcgtctctataaaaaaaagaatacaaaaattagttgggcatggtagtgagcgcctgtgaggctgcttgtgaggctgaggtgggaggatccctttagtccaggagttcaaggctgcagtgagctgtataatgccactgcagtccagcctgngtgacagttanaccctgtctncnnatctanattttntgnaaagnanacnttaaggntangatgaaat

SEQ ID NO: 1176 - DNA, 300 bp, Homo sapiens
gagcattccatcgtcttcattagctcttctatcctctgtcctgtcctctagcaagacacgctggatgcagatatccacatagagacggaggatcatggcatgtataagtacatgtcttcccagcacctcttcaagctgttggactgtttgcaggaatcccattcattctcaaaggccttcaactccaattacgagcagcggactgtcctgtggcgagcaggtaaggccacacagcagataagatagatggccacactggtcaccttcctaaaacattaaagtgcttggaaaatgcccaaa

SEQ ID NO: 1177 - DNA, 282 bp, Homo sapiens
  misc_feature (1)...(282): n = A,T,C or G
aattccgttgctgtcggaaatgtggaagctacctttaggaacatggagaatttccaaaccaacaggcaaaggaaaactaacgcacaaaaatgacattctgaagatgcaggtttcagccaggcgcggtcgagagaanatanaaacggtcaattacccnacatatnctgaggctgagaaatagtgctnagatggaaganatgaactncnagtctctggtcgaccatnctnanttctnaccnttnnngncnnactgtanatgaanagggctttnntcttctgtat

SEQ ID NO: 1178 - DNA, 300 bp, Homo sapiens
aattccgttgctgtcgtcctcttcctggcccagaagatcttcaatgacaacagcctcagtatggaggccttccagcaccgttctgtgtcctggtcgcagttcaacaaggtcattctcctgccctttggacctcccacccccaagctcttcatccctggggcactcagggcctgctcagcctccatgcagggaccttccactggattctccacagtgccccctcaggtcctttaggaaggcctgtcatggaccagggaggaaaaaccccaggcctgggggttggctctggagatgcgttct

SEQ ID NO: 1179 - DNA, 300 bp, Homo sapiens
atgcccccggggccctggcccagaccgccgcccccggtccgggcaggaaggagctgaagatcgtgatcgtgggcgacggcggctgcggcaagacctcgctgctcatggtgtacagccagggctccttccccgagcactacgccccatcggtgttcgagaagtacacggccagcgtgaccgttggcagcaaggaggtgaccctgaacctctacgacacggccgggcaagaagactatgaccggctgcggcccctgtcctaccagaacacccacctcgtgctcatctgctatgacgtcatga

SEQ ID NO: 1180 - DNA, 300 bp, Homo sapiens
aattccgttgctgtcggctaagacaatctcagcttttcttagacaatcttctatctcaaacttcagacattccagaattgtcatgatgtttacactgtctgagttaaaaatcctgttcaagaaaaaaaaaagattttgtatcacttcttaaaaaggaatattcatagcacttgtcacaaatagaaggcaaccatgagataatacaagccagggagaggcttgtattacatgacaggtgtaattagtctgctgagccagctttacccaatgaagggcatatgtgttagagagattagctaa

SEQ ID NO: 1181 - DNA, 263 bp, Homo sapiens
  misc_feature (1)...(263): n = A,T,C or G
aattccgttgctgtcggttctgggccagaaagacttccagtttggagtcgtttgctgcggggagggaatgaatgggcgctgggaacacgcccgcgaggtggggacgcgccggccgtatcnaggncnttagnnngagaacggccnacngncatctnnttcatgcnccntnnnaacntnactnntagnnnactttnnnncgtgacttnnccttantgtaaaatannttntncnngacncagccganttcatccanntcttnnngg

SEQ ID NO: 1182 - DNA, 300 bp, Homo sapiens
aattccgttgctgtcggttgaagcctgggcaggtggtgtacaagtgccccaaatgctgcagcatcaagcccgaccgagcccaccactgcagtgtttgtaagcggtgcattcggaagatggaccaccactgtccctgggtcaacaactgtgtaggcgagaacaaccagaagtacttcgtcctgtttacaatgtacatagctctcatttccttgcacgccctcatcatggtgggattccacttcctgcattgctttgaagaagattggacaaagtgcagctccttctctccacccaccacag

SEQ ID NO: 1183 - DNA, 300 bp, Homo sapiens
aattccgttgctgtcgaagagacagctatatttgtttcaatgtgtacctctccttctaaactcagttcttaagcatatagtatctttatagctatacacctagtgtctatcagaccctaaactatggtaggccctcaatacattttattgttataggtagatagataggcatgagtagggcaggagagggctctccctccacccactagaaatgtcaagtgatgttttaaaaattgtcacactgcctctcagaaaatgataattcagcaaccggggagagaatcttctgatggtccacac

SEQ ID NO: 1184 - DNA, 300 bp, Homo sapiens
aattccgttgctgtcgcctttccaggtccttccaactttgttaatttgttctactgcctgggagattcctttgactttatctttttacctttatattgaaggttttcagctgtcatatttttaatttctggtagttttttcttgtctattccttaattttttctttggagacagggtttcactctgtcacccaggtttgtgacagccttactgcagcctcaacctcctgggcccaagcaatcctcccacttcagcctcctgagtggttgggaccacaggtgcataccaccacacgtggct

SEQ ID NO: 1185 - DNA, 272 bp, Homo sapiens
  misc_feature (1)...(272): n = A,T,C or G
aattccgttgctgtcgacaaagtcgcagatgcatacaagactttttcaagaaacacatacagtacaaattcttagatgaagactttgtgttcgatatatacagagacagtagggggaagggggggaagnttcntgnnacntctttgntnatcctnnnnnnncatgatttactactttaangnggnnttgntggntantngnaccatgnncattncttnanngtcnngnttttcttantaantcgnntnttncntnnactgncctaanatnnt

SEQ ID NO: 1186 - DNA, 288 bp, Homo sapiens
  misc_feature (1)...(288): n = A,T,C or G
aattccgctgctgtcgcccaaactaaaaccttatctgtctgcattttgaatgcattttggtcaaaagtatacgttttaaagatttttaaagataaaaatgtggcncaacngggtttttttgctnnctgatntangnccctatcnntaanntaatctttctctccnnanccanantncaccantatggtnnaactannnntnaactnacantgaannnttaattngnnnntttcnnnaannntttcnaatntaaatnnctanngnttncaactngctcgnnngaaattc

SEQ ID NO: 1187 - DNA, 261 bp, Homo sapiens
  misc_feature (1)...(261): n = A,T,C or G
aattccgttgctgtcggcttgggattcttttatctcctgtggtggataaatctgccttaaatatcaatgtaacttgggggctgggggcttgttttgggtgccaancncatctctttanggacagnntaaatgngattatatctcangnacagttggaccttcagacctaacnntnaccattnnccttacctgtntaantctgaaatgtaatanganagataactgcnagatgccagctntcctaatntncaaagcctttca

SEQ ID NO: 1188 - DNA, 300 bp, Homo sapiens
aattccgttgctgtcgaaaccaaggacacagtcagcatttaacaaaaaggaatctgcatctcagtcagaactgtattgcatttgcttctctctggattaccttgaagttactccccttccccaagcagtgaaacgatggaccaaaggggtaaatctctttgaacaagaaattattctggtgcctattcatcggaaggtacattggagcctggtggtgattgacctaagaaaaaagtgtcttaaatatctggattctatgggacaaaagggccacaggatctgtgagattctccttcagta

SEQ ID NO: 1189 - DNA, 300 bp, Homo sapiens
aattccgttgctgtcgcgaatggtgaccccctggacggaagcgcccagaaggtgccgagtcccgatccccagcccagcactcgcggcatcttcggcctttgccactattttggtttttatgatttttaacaaggagcgtgaaagcttcagctgcgcctgagcccacgtgggcagcgggacggcataggggtggcccccatagaagccgggctgggggtggcctccgtagggttgtctggtgtttccacgtggggtgctaagaagcaaggcctggctgggtgcggtggctcccgcctgtga

SEQ ID NO: 1190 - DNA, 300 bp, Homo sapiens
aattccgttgctgtcgggcaaggaaggattcttctgaagctttcggaggaagcatggcccggccaacaccttgatttctgatttctaaactactcagcccgcctgcacccaggtgaaataaacagccttgttgctcacacaaagcctgtttggtggtctcttcacatggacacatgagacacttggtgccgaagacccaggtcagtgagactccttcaggagaccagtcccctgtcctcaccctcactccgtgaggaaatccacctatgaccttgggtcctcagaccaaccagcccaagg

SEQ ID NO: 1191 - DNA, 300 bp, Homo sapiens
aattccgttgctgtcggtttaccagctacataggatagggcctaacaaagacttactagcacaaagcaaggaggtttcaaggaagttagtttataaaagaaactattattttttaacacttatgatttattctttaacaagaagggaaactttgaagaggaacttttactttccacattgaacaaataagtaagaaaaagaaagggaaacttccccagggctgaaaggaaattttcaggtcatgccattattatcagaattaataagacccatgcatcgtggaaaactgagaacaccacg

SEQ ID NO: 1192 - DNA, 260 bp, Homo sapiens
  misc_feature (1)...(260): n = A,T,C or G
aattccgttgctgtcgccggagcgcacccggccggaagccgctgtcggggagccggcggtggggctggacgcaggtgcaactgacatgggtgaaccccagggatccatgcggattctagtgacagggggctctgggctggtaggcaaagccatccanaaggtggtnntnaatggagttgnactttntggataggatttntntgttagttncnantnttactntgntntaatctttngnantnttnggannttttttgttt

SEQ ID NO: 1193 - DNA, 300 bp, Homo sapiens
aattccgttgctgtcgatctcaccctgggaagatgtggtgccccctccagggctctggaggatggatgcctcccccaggggctctccaagctgggcatttgggcctggtggatgccaacctggataacctgtggcccagcattgactgtccacccagccttgctgttaggcaccatgactccaagatgaagatgtggtccctgcccttgagtgacagcccagggacttaatgtggccatcgggcatcaagcacaaggccatgcaggtgatgatacgtcggaatagaggcaccagccctgg

SEQ ID NO: 1194 - DNA, 300 bp, Homo sapiens
aattccgttgctgtcgggaagctcgatgtcccaatattggagagtgttggggaggtggagaatatgccaccgccacagccacgatcatgttgatgggtgacacatgtacaagaggttgcagattttgttctgttaagactgcaagaaatcctcctccactggatgccagtgagccctacaatactgcaaaggcaattgcagagtggggtctggattatgttgtcctgacatctgtggatcgagatgatatgcctgatgggggagctgaacacattgcaaagaccgtatcatatttaaagg

SEQ ID NO: 1195 - DNA, 265 bp, Homo sapiens
  misc_feature (1)...(265): n = A,T,C or G
aattccgttgctgtcggtggaggttgccgtgagctgagattgcgtcactgaactccggcctgggtgacagaaggaggctctgccttaannganaaaaaancntcntggaactgttgnanggataaaatnaaggattgaggnattgaggnattgntgacntgnacntcnaggngtcnnatttttttaaangggggggcncgnaccgggnccgnntncntnttntttcnaggcaggtgggnntgngnnaanncaanaggnattccnt

SEQ ID NO: 1196 - DNA, 257 bp, Homo sapiens
  misc_feature (1)...(257): n = A,T,C or G
aattccgttgctgtcggtgaatgatgatgatgccattgttgctgcttcgaagtgcttgaaaatggtttactatgcaaatgtagtgggaggggaagtggacacannttncantgannaagatgntnaagagcccatncctnagaccancttatntnatacctnttganctnttnngatntcatntnangtntcannatntgccntnnnctnngccacnnggcnntatgcnttntnngncnattntttntncntcatct

SEQ ID NO: 1197 - DNA, 286 bp, Homo sapiens
  misc_feature (1)...(286): n = A,T,C or G
aattccgttgctgtcgagatgaccctgctttcttggtcctgttaagtatctggctctgtgtgtccactataggatttggctttgtgctggacatgggattctttgagacaataaagcttctcctttgggttgcnctnatanattgtgnatgngcntgntcntntttncgttnnanaatnttcctttnnanancnggncatntaattnanttnaaaggaatnaccctngcccnnggnttaanaannanttcttnnanatnnggaacnttntcccctttnnaattttc

SEQ ID NO: 1198 - DNA, 300 bp, Homo sapiens
aattccgttgctgtcggacccataggcatgccagacatgggcatggggttcatgttcatctgtcccatgtgaccactgctgccattcatgtgcaccatactatacactgcaggattcccctggtgggcaaactgctgctgggaaaaggagctgtaagtaaacaaatggtaatattacctctggaagtcactttagcgacaaagggcatgcccacagaaattactacaattgtgtcaaacattgctatacttaagctgggaatgttagagaaaactccctgacagcctgtgatccattttt

SEQ ID NO: 1199 - DNA, 300 bp, Homo sapiens
aattccgttgctgtcgaccagacagagcttccagagtgtcaggacatgtgtgacttagcccagattcagactttagtcacaagcaggatcagcatagacatctagctcccagcatggcaattctctgttgtgtctccctgtttgtattggctgcaggaaagctcagagccaagtctgcgataagctgatcctaagtgtgaacgtgaagtccccagccctgctgctgagccagttgctgccctacatggagaacaggaggggtgctgtcatcctggtctcttccattgcagcttataatcc

SEQ ID NO: 1200 - DNA, 300 bp, Homo sapiens
gggcggctccgggcaggggggcacgatcttaaggacagtcgctccctgaacgcggagccggaggagacgaagggaaggtggagcggacgccacccgcgcaccgggcaggcgcggagaccggcgtgggacagccacctggagcgcagctgccagaaagaaggactttgctgctttgggccaggatctgaacttaggtgtaaaccattgccctggcagagggaacctacccagtccattgctgcctgctacaagatatgaacagtaatggcacatattttggttatgagtcactcagtggac

SEQ ID NO: 1201 - DNA, 300 bp, Homo sapiens
aattccgttgctgtcggcatcagcaggcactgtcctccctggagctgctcaacgttctcttcaggacctgcaaacatgagaagctgaccttggacctgacggtgctcctgggtgtgctgcaggggcaacagcagagcctacagcagggggcacactccaccggctccagccgcctgcacgacctctactggcaggccatgaaaaccctgggagtccagcgccccaagttggagaagaaggatgccaaggagatccccagtgccacccagagccccatcagtaagaagcggaagaaaaagg

SEQ ID NO: 1202 - DNA, 300 bp, Homo sapiens
aattccgttgctgtcgatgctcccaggtctccagtgtcacctctcggtacagtgtcctctgggccaggtccagctgttcccactcctcctgtgtgaatgccatagccacatcctcgaagcacacagatgcctgaaacagggcacttgttactgctcagagaccccaggtcctcatgccctcacggaggtacctgttaaggcctaaatgttggtgtccccccgtaaaattcatacattggaacctaatacccagtgagatagtgttaagaggtggggtctttacaaggcaattaatgtcct

SEQ ID NO: 1203 - DNA, 298 bp, Homo sapiens
  misc_feature (1)...(298): n = A,T,C or G
gaaaggcaccagtatgtgttttagattgatttccctgtttcagggaaatcacggacagtagtttcagctctgatggtataagcaaaacaaataaaacgtttataaaagntgtatctngatacactgnnnttnnacatgnnancannttatgnnnnntantctatgccaccttnnngtcacntnttnnannctctancnttncancttncttgntncntntcctnattcgnnngtgccaagagantntntncngnagnnaccnttcctttgccaccttcttgctctgtntntattacct

SEQ ID NO: 1204 - DNA, 300 bp, Homo sapiens
aattccgttgctgtcgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgccttcccctctcagacatggcttccttattgctggaagaggaggc

SEQ ID NO: 1205 - DNA, 267 bp, Homo sapiens
  misc_feature (1)...(267): n = A,T,C or G
aattccgttgctgtcggcaggttggtgtcaaaggaaatccccaaggcttcaaccagggtctggattgtgatgtgatcgtagctgaggtatgtgcttctcaggcctgcaaagcttccacatttttgttganatnanttattcatgnngacttgtatcnnnctcnnnacnnttnnntcnctnnaanctgnntannnctatnntnancttcgnaactnatcttgattacntnttctncatcntannnttnatttnantaannnntgntga

SEQ ID NO: 1206 - DNA, 300 bp, Homo sapiens
gccacgggatcctcagcggcttcaacaagacggttctgcggacgctcccgcggagcggaaacctcattgtggtggagagcgtgctcatggcagtggccttcctggccatgctgctggtgctgggtttgtgcggagccgcttaccggcccacggaggagatcgatctgcgcagcgtgggctggggcaacatcttccagctgcccttcaagcacgtgcgtgactaccgcctgcgccacctcgtgcctttctttatctacagcggcttcgaggtgctctttgcctgcactggtatcgccttgg

SEQ ID NO: 1207 - DNA, 294 bp, Homo sapiens
  misc_feature (1)...(294): n = A,T,C or G
gtagagaacaacctgctgcatctggaagacttatgtgggcagtgtgaattagaaagatgcaaacatatgcagtcccagcaactggagaattacaagaaaaataagaggaaggaacttgaaaccttcaaagctgaactagatgcagagcacgcccagaaggtcctggaaatggagcacacccagcaaatgaagctgaaggagcggcagaagttttttgaggaagccttccnccnggacctggacctgtanctgttcnntgggtacntnctgaannttgngtgtnntnagctcctt

SEQ ID NO: 1208 - DNA, 300 bp, Homo sapiens
aattccgttgctgtcgctggtgatgagatcgggaaagtgggctcaggaggtctggatctgtgatgagatggggaaagtgggctcaagaggtctggatctgtggtgagatgggggaagtgggctcaggaggtctggatctgtgatgagatggggaaagtgggctcaggaggtctggatctgtgatgagatggggaaagtgggctcaggaggtctggatctgtgatgagatgggggaagtgggctcaggaggtctggatctgtgatgagatgggggaagtgggctcaggaggtctggatctg

SEQ ID NO: 1209 - DNA, 278 bp, Homo sapiens
  misc_feature (1)...(278): n = A,T,C or G
aattccgttgctgtcgcagccttatcattggttatgccagaaacccttcgctgaagcagcagctgttctcatatgctatcctgggatttgccttgtctgaagctatgggtctcttttgtgtgatggttgcttncttgngngtgcttnncangaccnaagancataggaaacacctgagtagctcttntcgtgctggccaccaggagaaggagcantatagtcgcctgagngnnggcggccattatnacagccngaanacactttctacntcttcaatg

SEQ ID NO: 1210 - DNA, 281 bp, Homo sapiens
  misc_feature (1)...(281): n = A,T,C or G
aattccgttgctgtcggaagctagatggactaggagagacttgattttggtgctaaagttccccagttcatatgtgacatctttttaaaaaaaataacaacaaaaaaaaaatgananaaaagctaaaaaaaaangnanggggngancagtnaanggnattnattccacatncaanatcngggnaaaacgatttcctgtaaaagnaccttnaagggttttngntntaaaannccgnaggtctatccttaaagcantnacnccangctttnttccctgggttt

SEQ ID NO: 1211 - DNA, 300 bp, Homo sapiens
aattccgttgctgtcgctcagcccgcctgcacccaggtgaaataaacagccatgttgctcacacaaagcctgtttggtggtctcttcacagggacacggatgaaatttggtgccgtgactcggatcgggggacctcccttaggagatcaatcccctgtactccttttctttgccctgtgagaaagatccacctatgacctcagtcaggtcctcagaccgaccagcccaaggaacatctcaccaattttaaatcagaccttgaagatttgttgttcaaggagaaactgaagagcaagaagg

SEQ ID NO: 1212 - DNA, 293 bp, Homo sapiens
  misc_feature (1)...(293): n = A,T,C or G
aattccgttgctgtcggaaatgacccgccctcaatgctggctgctgctaacattaatgagaaggtggccttcagcgtgnanctgaggnnnnaangncacannanntgaatgcttnnagcgacngaaatggaatattctganaatgancannancnncaccactacnacagaaagangttggaggctnctgtaccctgntcattccttangggncntgcttnccttaataagtaagtaagttggtntacngccctnnatatgcaaatgagagctgaaagtttttaaaaggtaca

SEQ ID NO: 1213 - DNA, 280 bp, Homo sapiens
  misc_feature (1)...(280): n = A,T,C or G
aattccgttgctgtcgctttgaaatgtaacaaatggtactacaaccaattccaagttttaatttttaacaccatggcaccttttgcacataacatgctttagattatatattccgcactcaaggagtaaccaggtcgtccaagcaaaaacaaatgggaaaatgtcttaaaaaatcctgggtggacttttgaaaagcttttttttttttgaaacggagtnttgctntgtngcccaggntgnagggcannannncnatctnggntaattgcaccntccgttt

SEQ ID NO: 1214 - DNA, 259 bp, Homo sapiens
  misc_feature (1)...(259): n = A,T,C or G
aattccgttgctgtcgctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagagggtttnactctctgctanagcgtagacgatnnantttacnctntcnnanctcnatnttncanct

SEQ ID NO: 1215 - DNA, 276 bp, Homo sapiens
  misc_feature (1)...(276): n = A,T,C or G
aattccgttgctgtcggtctctgtgtgtacctcccattgagtagagaagcttaagataatttctgagagaagaacactgctgattgtgggagcagtttaggagtccatggaagaaagaaaaatacatgtgtcttggcagccatggtgtatttttgtccaaatggattggaaggatatttgaatatttgaatgntgntncnacataangttgannnncactntcnattcnnccnntgaantacantnctgncnancnctntcnccttaatntcnttc

SEQ ID NO: 1216 - DNA, 299 bp, Homo sapiens
  misc_feature (1)...(299): n = A,T,C or G
aattccgttgctgtcggtagagatcatctttacagttcctcgggaaaatgtgaatgtgctgcgttttgttttctttactgtatgaaaacaggaaaataaaagagaaatttagaaaatacagctcattacaataaaattgttggatttcatttccccaggtcttcagtgttgatgtaaatgtgttttgtagtgttgcttagcactttgcgcattgtgtangttgggtaacanntanggctanctaanngcannntttccanncntttngntctgaanaccttcntttannctgcccattg

SEQ ID NO: 1217 - DNA, 296 bp, Homo sapiens
  misc_feature (1)...(296): n = A,T,C or G
aattccgttgctgtcgcagctttattgctcacacaaagcctgtttggtggtctcttcacacggatgcgcatgaaatttggtgccgtgactcggatcgggggacctctcttaggagatcaatcccccgtcctcctgctctttgctccatgagaaagatccacctatgacctcaggtcctcagaccgaccagcccaagaaacatntcaccaatttcaaatctggncttcanatggaaaggancnngtatccnnaaagangtgatcaangattgcntnctgagganntcatatgcactt

SEQ ID NO: 1218 - DNA, 300 bp, Homo sapiens
aattccgttgctgtcgcgaaataatacgtgtagatgcccctgatccaggtgcagacccgctggctagcagtgtgaacggcatgtgcctggatattcctgctcacctgagcatccgcatcctcatctcggatgctggcgcggtggaagggattactcagcaggagatactcggtgtagagacaaggttctcctcagtgaactggcagtaccagtgtgggcttacctgtgagcacaaggccgaccttctccctatcagtgcatccgtccagtttattaaaattcctggcagttaccccaccc

SEQ ID NO: 1219 - DNA, 300 bp, Homo sapiens
aattccgttgctgtcggccaggaaaggcaaggggcagatcgagaagaggaagctgcgggagaagcggcgctccaccggcgtggtcaacatccctgccgcagagtgcttagatgagtacgaagatgatgaagcagggcagaaagagcggaaacgagaagatgcaattacacaacagaacactatacagaatgaagctgtaaacttactagatccaggcagttcctatctgctacaggagccacctagaacagtttcaggcagatataaaagcacaaccagtgtctctgaagaagatgtctc

SEQ ID NO: 1220 - DNA, 300 bp, Homo sapiens
catcttggccatgctggtcttgaactcctgacatcgtgatccatctgcctcggcctcccaaagtgctgggattacaggcatgagccacagtgcccggccattttgcccattttttaatcaggttatttgcttttttgggaagattcgcggccgctatctacgtagatccagacatgataagatacattgatgagtttggacaaaccacaactagaatgcagtgaaaaaaatgctttatttgtgaaatttgtgatgctattgctttatttgtaaccattataagctgcaataaacaagtta

SEQ ID NO: 1221 - DNA, 300 bp, Homo sapiens
aattccgttgctgtcgagcaaataccaaggcctaaaaaagaatgaattatttgctgtttgggaaatggaagcccacgctgagtgctgaagcacagggactctgcgcaggaagaggaggggaagcaagaaatgaatttgggtccttgtgatggcagtggctgctgccatcacgctgtgtggctagggctgcacacttcatggagccggtggaagccccgtccctcatgagttgggactggagccgcaaaccgctgctgcagacccaggccttctgctctatggagcaggcaggagccccac

SEQ ID NO: 1222 - DNA, 270 bp, Homo sapiens
  misc_feature (1)...(270): n = A,T,C or G
aattccgttgctgtcgcagccttgttttatgccacttttctctccccataccttcccctcatgtgtacttagccacctgtgttgctttgaatctgctgccagttctggctcaaatgtggcacaaaatnagnacttnagacgcaccatganntncntgtggctatnnnttctnangantngtttnacnnttnctgtnntatnntntgnttangnttnagnngtnnnnnntannnnnaaatannnnatgatgnttntgncnatcnntntnat

SEQ ID NO: 1223 - DNA, 300 bp, Homo sapiens
aattccgttgctgtcgcttcgtggagctcttccagagctggccgctgctggagaggccctggaaggccttcctcaacctctcggccatcgtgctcttcctgttcatctgtggcctcctgccctggatcgacaacatcgcccacatcttcggcttcctcagtggcctgctgctggccttcgccttcctgccctacatcaccttcggcaccagcgacaagtaccgcaagcgggcactcatcctggtgtcactgctggcctttgccggcctcttcgccgccctcgtgctgtggctgtacatct

SEQ ID NO: 1224 - DNA, 300 bp, Homo sapiens
  misc_feature (1)...(300): n = A,T,C or G
aattccgttgctgtcggaagaacataaacaggatgctgagagattgggtctctccacattgccccggctgctctccaacccctgagttcaagtgattcacctcccttggcctcccaaagtactgggattacaggcgtgagccaccgtgcctggctgagaagatggatttaagacatattttggaggtaacattgtcaggacttcctgaaggattanatgtggaagggaaggataagaaacagaccaaggataactttcaaatgtatgcttaagcaactggatggataatgatgccattga

SEQ ID NO: 1225 - DNA, 286 bp, Homo sapiens
aattccgttgctgtcgcgaatggtttagcgccaggttccccacgaacgtgcggtgcgtgacgggcgagggggcggacgctatctacttagatccagacatgataagatacattgatgagtttggacaaaccacatctagaatgcagtgaataaaatgctttatttgtgaaattatgtgatgctattgttttatttgtaaccattataagctgcggatatacaagttaacaacaacaattgcattcattttatgtttcaggttcagggggaggtgtgtgaggtttta

SEQ ID NO: 1226 - DNA, 268 bp, Homo sapiens
  misc_feature (1)...(268): n = A,T,C or G
aattccgttgctgtcggcgcggggcagcaacagtcgcaggagatgatggaggttgacaggcgggtcgagtctgaagaatccggcgatgaagaagggaagaaacacagcagtggcatcgtggccgacctcagtgaacagagcctgaaggatggggaggagcgnttgnagganganttnnnnnnnttnttntngtgcttnnncanttnnantnnncttccntnanagttngctnnangnnnnnnttttatannntatcnnnnnnatcatt

SEQ ID NO: 1227 - DNA, 289 bp, Homo sapiens
  misc_feature (1)...(289): n = A,T,C or G
aattccgttgctgtcgcaggaagtgaggatacttctggcgagcgccggttgctgtttcttctcaggctcagggaccggccgcggccccgtagggggttttaactcaaatgggtgatgaaaaggactcttggaaagtgaaaactttacatgaaattcttcangaaaagaaacgaanganggaacangaggagaaagcagagataaaacgcttaanaaattctgatgaccgggattccaagcgggattcccttgaggagggggagctnanagatnactgcatggagatcac

SEQ ID NO: 1228 - DNA, 264 bp, Homo sapiens
  misc_feature (1)...(264): n = A,T,C or G
aattccgttgctgtcgctttttatcacctcccctcctcacacctggtccggcttacagtttcgttccgtgactagccctcccccacctgcccagcaatttactcttaaaaaggtggctggagctaaagacatagtcaaggttaacgctcctttttctttatccnnaatnngatacgtntaagntcctttttnaanncannttannnnnnagncnanntnatgncttnanncncnntnancntgctgagacncannaatntttaa

SEQ ID NO: 1229 - DNA, 300 bp, Homo sapiens
aattccgttgctgtcgggagtcggaacatcatcttcagcgggctatttcagcacagcaggtgtatggcgagaagagggataatatggttataccggtcccagaggcagaaagtaatattgcttactatgagtctatatatcctggggaatttaagatgccaaagcagctcattcacatacagccttttagtttggatgctgaacagcctgattatgatttggattctgaagatgaagtatttgtgaataaactgaaaaagaaaatggacatctgcccattgcaatttgaggagatgattg

SEQ ID NO: 1230 - DNA, 300 bp, Homo sapiens
ctatctacgtacagccagacatgagaagatacattgatgaggttggacaaaccacagctagaatgcagtggagaaaatgctttatttgtgaaatttgtgatgctattgctttatttgtaaccattataagctgcattaaacaagttaacaacaacagttgcattcattctatgtttcaggttcagggggaggtgtgggggtggagttgttcaggtatcttgggatatatatatgcattctaaaatctgtagcagcataactcctttgggaatcatgagacatttttgtctcttacctgtt

SEQ ID NO: 1231 - DNA, 300 bp, Homo sapiens
aattccgttgctgtcgcaggaggaagccgcctacatccaagagatcaccacggcagatggccagaccgtacagcacctggtgacctccgacaaccaggtgcagtatatcatctcccaggatggtgtccagcacctgctcccccaggaatatgttgtggtccctgaaggccatcacatccaggtacaggagggccagatcacacacatccagtatgaacaaggagccccgttccttcaggagtcccagatccagtatgtgcctgtgtccccaggccagcagcttgtcacacaggctcaact

SEQ ID NO: 1232 - DNA, 300 bp, Homo sapiens
aattccgttgctgtcgccaggaccctggggaaaggaagccagcccccagggccagtcccggaggggctgatccgcatctacagcatgaggttctgcccctattctcacaggacccgcctcgtcctcaaggccaaagacatcagacatgaagtggtcaacattaacctgagaaacaagcctgaatggtactatacaaagcacccttttggccacattcctgtcctggagaccagccaatgtcaactgatctatgaatctgttattgcttattcttgagtatcagaacaccaccttctttgg

SEQ ID NO: 1233 - DNA, 300 bp, Homo sapiens
aattccgttgctgtcgcccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggatcctcctgtttaccctgtacctccaatgtctggcacttgtaggtgctcaaatattcgttgaatgaatgaaaaatccatattgtaattgatgtcctctggccacatagttttaaaattaggtgattgattatatg

SEQ ID NO: 1234 - DNA, 279 bp, Homo sapiens
  misc_feature (1)...(279): n = A,T,C or G
aattccgttgctgtcgttcaaatatggagattaatcaccaacttcttattttttgggccagttggattcaattttttatttaacatgatttttctatatcgttactgtcgaatgctagaagaaggctctttccgaggtcggacagcagactttgtatttatgttcctttttggtggattcttaatgaccctttttggtctgtttgtgagctgagttttcttgggccaggcctttacaataaggcacgtctntgngtggnncncnantgaaccccttatg

SEQ ID NO: 1235 - DNA, 300 bp, Homo sapiens
aattccgttgctgtcgggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgttcattgtttcgtaacacagcattgtatatgtgaagcaaactctaaaattataaatgacaacctgaattatctatttcatcaaaccaaagttcagtgtttttatttttggtgtctcatgtaatctcagatcagc

SEQ ID NO: 1236 - DNA, 207 bp, Homo sapiens
  misc_feature (1)...(207): n = A,T,C or G
aattccgttgctgtcgctcagttttggcggagcaaagtcctagaggtggccaaggacttccctgagtacacctttgccattgcggacgaagaggactatgctggggaggtgaaggacctggggctcagcgagagtggggaggatgacaatgccgccntcctgaacgacagtgggaaaaagantgncntttngnnanangannnngnt

SEQ ID NO: 1237 - DNA, 300 bp, Homo sapiens
aattccgttgctgtcgcccaggccatgaagcattatacagaagccatcaaaaggaacccgaaagatgccaaattatacagcaatcgagctgcctgctacaccaaactcctggagttccagctggcactcaaggactgtgaggaatgtatccagctggagccgaccttcatcaaggggatagtcccctttctgaaaacactcgttgcctttgttcttctcctccaaagccagctaaattccaaataccagagactgaaattttcagccttgctaagggaacatctcgatgtttgaaccttt

SEQ ID NO: 1238 - DNA, 249 bp, Homo sapiens
  misc_feature (1)...(249): n = A,T,C or G
aattccgttgctgtcggctgacagctattttgaaatttggagcagaggatctcttcaaagaactggaaggggaggaatcagaacctcaggaaatggatatagatgaaattttgcggttggctganacganagagaatgaagtgtcancnagtgcncagatgaanttctatcacagantaaggttgtnaantttgcagcnatggangatgngtaactnntntaaaancntggncntgnttngtngggata

SEQ ID NO: 1239 - DNA, 269 bp, Homo sapiens
  misc_feature (1)...(269): n = A,T,C or G
aattccgttgctgtcgggacaacgccaagctggtgcctgtgctctcagccaaggcggcccaagccagtgacctggaaaaaatccacctggatgagaagtctttccgttggttgcacaacgaggaccagatggctgtggagaagctttntgacgggatcngcaagtttgccngtgatgcagtnaagcnnnnncgcttncttgnnagatngaatgtntttatngttaatngnaanantttggtntctanntggtgtntntntnattatgnc

SEQ ID NO: 1240 - DNA, 294 bp, Homo sapiens
  misc_feature (1)...(294): n = A,T,C or G
aattccgttgctgtcgatattttggaggacgggtgaagaggtaataacgaaagcaagcgagtgaattaggatttcaaagtgccctaatagtgtgagtctccagttcctagaatatgaagagtgctgtcgttggggtgaaaccatgagactgacagatctgcctgaaatggggggtgtgtaangtgtcgtncctgagtggcnnggnnnngnggntatgngngntngngggnngnggnntngnntcggngnngntnncnnntgtgggnntgntntntatntnggnnngatttcggg

SEQ ID NO: 1241 - DNA, 285 bp, Homo sapiens
  misc_feature (1)...(285): n = A,T,C or G
aattccgttgctgtcggtatcgccaccgtgctgcagcacgaggagcgccgctgccagtacctcacccgggaggccaagctgatcctggcactccaggatgaggtgtccgccatggctgatggaaatgaaggtcctcagtccccattccatcacatcctgcccatttgcgtcattgcccnaaacctnaaggaancttatganagcctgngnncgtnagacgtantgcggcttcacatnaacanctggctnganntgagcttttgcntgncctacatgaaccactat

SEQ ID NO: 1242 - DNA, 250 bp, Homo sapiens
  misc_feature (1)...(250): n = A,T,C or G
aattccggtgctgtcgaaccatccagattagatgtcaccaacagtgagagcccagaaattcctttgaatccaattttggccttggatgatgaagggacacttgggcccctgcctcaggtagatggtgttcagacacagcagactgcagaagttatatgagtgntanttctgaanaaccnttgctgactttttntgnnaanttnttacantnanngnaatttctttcctgntctatnngatcantntctcc

SEQ ID NO: 1243 - DNA, 266 bp, Homo sapiens
  misc_feature (1)...(266): n = A,T,C or G
aattccgttgctgtcggaaagggctaaacatgtgaggcctggagatagttgctaagttgctaggaacatgtggtgggactttcatattctgaaaaatgttctatattctcatttttctaaaagaaagaaaaaaggaaacccgatttatttctcctgaatctttttaagtttgtgtcgntntttncggcngaactaanttcnatncnttgancttanctnntangctnggncctcnatncntnatnntncgnagagatcganncnnt

SEQ ID NO: 1244 - DNA, 300 bp, Homo sapiens
aattccgttgctgtcgaagtggcttagggatggggtagagtagttgacttatttggatgaaaaccactatcttctgtcagaaactcaaaaggaatcattgctggcatggtaacctaaagaaaaacaaccagacaagtgcccaacgacacttaaaaaggtgatttattagcttgccaagtttaggctgggcatggtgactcatgcctctaatcccagcattttgggaggctgaggctggtggatcaccggaggccaggactttgagaccagcctgaccaatatggcgaaacctcgtccctg

SEQ ID NO: 1245 - DNA, 300 bp, Homo sapiens
aattccgttgctgtcgcaattaaacaccccagtgtgaatgagaacttctgcaatgaaaaggaaggggctcagttcagcagtcatcttatcaatcttctgaaccctaaaggaaagccagcaaaccagctgcttgctctcaggactttttgcaattgttttgttggccaggcaggacaaaaactcatgatgtcccagagggaatcactgatgtcccatgcaatagaactgaaatcagggagcaataagaacattcacattgctctggctacattggccctgaactattctgtttgttttcat

SEQ ID NO: 1246 - DNA, 300 bp, Homo sapiens
  misc_feature (1)...(300): n = A,T,C or G
aatttcgttgctgtcggtggaagataaccacaaggccgacatcagctcctggttcatggaagccatagagtacatcgatgccgtgaaggactgccgtgggcgcgtgctggtgcactgccaggcgggcatctcgcggtcggccaccatctgcctggcctacctgatgatgaagaaacgggggaggtgtgggaggttttnccaagtgcttctgtagatancgtcantnggactagatattcnacaggccntaacttgantctattgccnntgtctttatnanatgtacnttttatattctgt

SEQ ID NO: 1247 - DNA, 287 bp, Homo sapiens
  misc_feature (1)...(287): n = A,T,C or G
aattccgttgctgtcggaaaaattaaagaagatgatgctccaagaacaatagcttgccctcataaaggctgcacaaagatgttcagggataactcggccatgagaaaacatctgcacacccacggtcccagagtccacgtctgtgcagaatgtggcaaagcttttgttgagagttcaaaactaaaacgacaccaactggttcatactggtgagtagccctttctgtgctcgttctaaggctgtgggaaacgctttncnctgtcttcanttngcncacncntgtgcga

SEQ ID NO: 1248 - DNA, 300 bp, Homo sapiens
  misc_feature (1)...(300): n = A,T,C or G
aattccgttgctgtcggccgagcttgacaccctcaacgaggactcctacaaggactccacgctcatcatgcagctcctccgcgacaacctcacgctctggacgagcgaccagcaggacgacgatggcggcgaaggcaacaattaaggccccaggggaactggcagcgcacgcggatgctactactgcagtctttatttttttcccatgagttgggggtcgggtgggggaggtgtgggagggnatgaccttcccagggagaaacccacgacctgtcctgnctttgatcgnctctttgacat

SEQ ID NO: 1249 - DNA, 291 bp, Homo sapiens
  misc_feature (1)...(291): n = A,T,C or G
aattccgttgctgtcggcagtttggggaagtctggatgggttactataacaacagtaccaaggtggctgtgaaaaccctgaagccaggaactatgtctgtgcaagccttcctggaagaagccaacctcatgaagaccctgcagcatgacaagctcgtgaggctctacgctgnggncaccagggaangagcccattnacatcatcatcgattacntngtnaaggncantntgntgaattttntgnttannnatnanngccannannntnnntctacnaaannntatttctat

SEQ ID NO: 1250 - DNA, 231 bp, Homo sapiens
aattccgttgctgtcggttttggaggcccttgcttttcttcatcatgagggctatgtccatgcggacctcaaaccacgtaacatattgtggagtgcagagaatgaatgttttaaactcattgactttggacttagcttcaaagaaggcaatcaggatgtaaagtatattcagacagacgggtatcgggctccagaagcagaattgcaaaattgcttgcccaagctggcctg

SEQ ID NO: 1251 - DNA, 289 bp, Homo sapiens
  misc_feature (1)...(289): n = A,T,C or G
tttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttcanncaccacctgacacttttgctgaagntgnaggacanactgaaccggcncctganctgngacctgatgccanacganaatatnccngagttgnngnntganctgnngcanntgggctacagtt

SEQ ID NO: 1252 - DNA, 300 bp, Homo sapiens
aattccgttgctgtcggagacacattacacctaaccaacaagaagaaggatcctcccccttataatttaactatgtttacagggaatgcgtacattgtggcttcccgagatttcgtccaacatgttttgaagaaccctaaatcccaacaactgattgaatgggtaaaagacacttatagcccagatgaacacctctgggccacccttcagcgtgcacggtggatgcctggctctgttcccaaccaccccaagtacgacatctcagacatgacttctattgccaggctggtcaagtggcag

SEQ ID NO: 1253 - DNA, 300 bp, Homo sapiens
aattccgttgctgtcggggggatcaggatactcctgctcacagacacccatctccccctaccaaaaataacgctggagtcctccttccaccctgactctgcctctctgtctgcaggagcctggtcggggtgctccacagaagctgtgcctgggcttgggagccaaggccatgtccctctcccggccaggggagacggagcccatccacagtgtcagctatggccatgtggccgcctgccagctaatgggcccccacaccctggccttgagggtgggagagagccagctcctcctgcagag

SEQ ID NO: 1254 - DNA, 300 bp, Homo sapiens
aattccgttgctgtcgcgagttcatccatcaatttcctgactcgagttagtggcattggtccatctgctgcaaggaagtttgtagatgaaggaattaaaacactagaaggctcacagctggattcatgcccagtaaagggacacctgaatggaactgagtcacttttagacttaatatgggatgttatgacaattcttaagttaaaaaatgcagatctcagaaaaaatgaagataaattgaaccatcatcagcgaattgggctgaaatattttggggactttgaaaaaagaattcctcgt

SEQ ID NO: 1255 - DNA, 300 bp, Homo sapiens
aattccgttgctgtcgggtgcctggctgccctagcaaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtattaccaccttgctcttgactggaaatgcaactgtggttaccacctgtgctgcaggtccgtcctgg

SEQ ID NO: 1256 - DNA, 300 bp, Homo sapiens
aattccgttgctgtcggggggatcaggatactcctgctcacagacacccatctccccctaccaaaaataacgctgggctcctccttccaccctgactctgcctctctgtctgcaggagcctggtcggggtgctccacagaagctgtgcctgggcttgggagccaaggccatgtccctctcccggccaggggagacggagcccatccacagtgtcagctatggccatgtggccgcctgccagctaatgggcccccacaccctggccttgagggtgggagagagccagctcctcctgcagag

SEQ ID NO: 1257 - DNA, 300 bp, Homo sapiens
aattccgttgctgtcggtggttgacgagctcggcggcggttttgctgagatctgtggccgtcggcagctggtgcggggggcagctgagagcgagaggtggatcggggcggtgtgtggccagggccatgacgggcaatgccggggagtggtgcctcatggaaagcgaccccggggtcttcaccgagctcattaaaggattcggttgccgaggagcccaagtagaagaaatatggagtttagagcctgagaattttgaaaaattaaagccagttcatgggttaatttttcttttcaagtggc

SEQ ID NO: 1258 - DNA, 252 bp, Homo sapiens
  misc_feature (1)...(252): n = A,T,C or G
aattccgttgctgtcgaataaaagcaaacagaacactccaacttagagcaataacggctgccgcagcagccagggaagaccttggtttggtttatgtgtcagtttcacttttccgatagaaatttcttacctcatttttttaagcagtaaggcttgaagtgatgaaacccacagatcctagcaaatgtgcccaaccagctttactaaagggggaggtgtgggaggttttgggatganaanacnngtttccca

SEQ ID NO: 1259 - DNA, 300 bp, Homo sapiens
aattccgttgctgtcgcgttcctgtctgagccccaagccacctcagggtcaagagcaacagggccaagaggatgaagtggtcttggtggaagggcccaccctcccagagaccccccgactcttcccactcaaaatccgttgccgggctgacctggtcagattgcccctcaggatgtcggagcccctgcagagtgtggtggaccacatggccacccaccttggggtgtccccaagcaggatccttttgctttttggagagacagagctatcacctactgccactcccaggaccctaaagct

SEQ ID NO: 1260 - DNA, 300 bp, Homo sapiens
aattccgttgctgtcgctgaaggtcatcaggcagtctgctgggcaaaagacaacctgtggccagggtctggaagggccctgggagcgcccaccccctctggatgagtccgagagagatggaggctctgaggaccaagtggaagacccagcactaagtgagcctggggaggaacctcagcgcccttccccctctgagcctggcacataggcacccagcctgcatctcccaggaggaagtggaggggacatcgctgttccccagaaacccactctatcctcaccctgttttgtgctcttccc

SEQ ID NO: 1261 - DNA, 300 bp, Homo sapiens
ccgcactatagaatacaagctacttgttctttttgcaggatcccatcgagaaaaaactggccatgcagaagtcgtccgagtggtgtaccagccagaacacatgagttttgaggaactgctcaaggtcttctgggagaatcacgacccgacccaaggtatgcgccaggggaacgaccatggcactcagtaccgctcggccatctacccgacctctgccaagcaaatggaggcagccctgagctccaaagagaactaccaaaaggttctttcagagcacggcttcggccccatcactaccga

SEQ ID NO: 1262 - DNA, 295 bp, Homo sapiens
  misc_feature (1)...(295): n = A,T,C or G
acgtacatccatacatgataagatacattgatgagtttggacaaaccacaactagaatgcagtgaaaaaaatgctttatttgtgaaatttgtgatgctattgctttatttgtaaccattataagctgcagtaaacaagttaacaacaacacttgcattcattttatgtttcaggttcagggggaggtgtgggaggntttnntggatctgnccgnccnccnnangtncacnncntgcnngtggcngangntnccntcaagccctngnnttnngntcctttcattgtccaacaatga

SEQ ID NO: 1263 - DNA, 256 bp, Homo sapiens
  misc_feature (1)...(256): n = A,T,C or G
gctatctacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttgccccntngcaaaggngnnctaggctctctnggngattnnnngttttcccga

SEQ ID NO: 1264 - DNA, 205 bp, Homo sapiens
gctatctacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttt

SEQ ID NO: 1265 - DNA, 300 bp, Homo sapiens
aattccgttgctgtcgtgaaaaggcaggtcctctgttatgaactatttcagagcaagacccgtcacagaaaatttaaagaaattcaagtcccatataatgtccagtggatggcaatcttcagtgaacaactctgtgtgggattccagtcaggatttctaagataccccttgaatggagaaggaaatccatacagtatgctccattcaaatgaccatacactatcatttattgcacatcaaccaatggatgctatctgcgcagttgagatctccagtaaagaatatctgctgtgttttaac

SEQ ID NO: 1266 - DNA, 239 bp, Homo sapiens
  misc_feature (1)...(239): n = A,T,C or G
ctatctacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttnntnnnnnnnnnnnnnnnngntttnntnnnnnng

SEQ ID NO: 1267 - DNA, 300 bp, Homo sapiens
aattccgttgctgtcgttcccattcagctcttggggtgaagccttattcctgatgctccagacgatcaccatctgcttcctggtcatgcactacagaggacagactgtgaaaggtgtcgctttcctcgcttgctacggcctggtcctgctggtgcttctctcacctctgacgcccttgactgtagtcaccctgctccaggcctccaatgtgcctgctgtggtggtggggaggcttctccaggcagccaccaactaccacaacgggcacacaggccagctctcagccatcacagtcttcct

SEQ ID NO: 1268 - DNA, 300 bp, Homo sapiens
aattccgttgctgtcgctaccattgcaagaccccagattgcaagggatggtgcttctttgaggatgatgtcaatgagttcacctgccctgtgtgtttccacgtcaactgcctgctctgcaaggccatccatgagcagatgaactgcaaggagtatcaggaggacctggccctgcgggctcagaacgatgtggctgcccggcagacgacagagatgctgaaggtgatgctgcagcagggcgaggccatgcgctgcccccagtgccagatcgtggtacagaagaaggacggctgcgactgga

SEQ ID NO: 1269 - DNA, 300 bp, Homo sapiens
atgaaatctctttcatccgagcaggagaaggtgctcttaaacaagccttggcaaatgcaacattatgtattcttgaacctattatggctgtggaagttgtagctccaaatgaatttcagggacaagtaattgcaggaattaaccgacgccatggggtaatcactgggcaagatggagttgaggactattttacactgtatgcagatgtccctctaaatgatatgtttggttattccactgaacttaggtcatgcacagagggaaagggagaatacacaatggagtatagcaggtatcagc

SEQ ID NO: 1270 - DNA, 300 bp, Homo sapiens
aattccgttgctgtcggcaactcggaggagaagaccccggcccccaggctagctgcggagaaaaccaagaaggaggagtacatgaagaagctgcacatgcaggagcgtgctgtggaggaggtgaagctggccatcaagcccttctaccagaagagggaggtgaccaaggaggagtacaaggacatcctgcgcaaggccgtgcagaagatctgccacagcaagagtggagagatcaaccccgtgaaggtggccaacctggtgaaggcgtacgtggacaagtacaggcacatgcgcaggcac

SEQ ID NO: 1271 - DNA, 300 bp, Homo sapiens
aattccgttgctgtcgagcactcgcagatttctgaaaggacaggacgaagatcaagtgcacagtgttcctatagcacaaatggggaactaccaggaatacctcaagcaagtaccttctccactaagagaacttgatcctgatcagccacgaaggttgcatacatttggcaacccctttaagctggataagaagggtatgatgatagatgaagcagatgaatttgtggctggacctcaaaataaacataaacgacccggagaaccaaatatgcaagggatccctaaaagacgtcggtgttt

SEQ ID NO: 1272 - DNA, 300 bp, Homo sapiens
aattccgttgctgtcgatgcgaccaagggcatcactcggtgcctcctgaatgaaacaaccaacaataagaacgagaaggagcttgtgctaaacacagaaggaatcaacctcccagagctattcaagtatgcagaggtcctggatctgcgccgcctctactccaacgacatccacgccatagccaacacgtatggcattgaggccgcgctgcgggtgatcgagaaggagatcaaggatgtgtttgccgtgtatggcatcgcggtcgaccctcgccatctctccctggttgctgattatatg

SEQ ID NO: 1273 - DNA, 300 bp, Homo sapiens
aattccgttgctgtcgaattggtttggcacctactacaggatgatccagaccaacttcattgacatggagaacatgtttgacttgctgaaagaggagacagaagtgaaggaccttcctggagcagggccccttcgctttcagaagggccgtattgagtttgagaacgtgcacttcagctatgccgatgggcgggagactctgcaggacgtgtctttcactgtgatgcctggacagacacttgccctggtgggcccatctggggcagggaagagcacaattttgcgcctgctgtttcgctt

SEQ ID NO: 1274 - DNA, 300 bp, Homo sapiens
aattccgttgctgtcggcattcgcattcctgctctcttacccccaacgtccacagagctggatgttcctcacaatgtccaagtggctgcagtggttggcattggccttgtatatcaagggacagctcacagacatactgcagaagtcctgttggctgagataggacggcctcctggtcctgaaatggaatactgcactgacagaaagtcatactccttagctgctggcttggccctgggcatggtctgcttggggcacggcagcaatttgataggtatgtctgatctcaatgtgcctgag

SEQ ID NO: 1275 - DNA, 300 bp, Homo sapiens
aattccgttgctgtcgagcagcggaagcgtgaggctgaggagcggcgccgcttccccctggagcagcgactaaaggagcacatcattggccaggagagcgccatcgccacagtgggtgctgcgatccggaggaaggagaatggctggtacgatgaagaacaccctctggtcttcctcttcttgggatcatctggaataggaaaaacagagctggccaagcagacagccaaatatatgcacaaagatgctaaaaagggcttcatcaggctggacatgtccgagttccaggagcgacacgag

SEQ ID NO: 1276 - DNA, 300 bp, Homo sapiens
aattccgttgctgtcgcttacttctcacacccagccatccgctatcaccctcaggagacgctgaaagaatttgtccaacttgtctgccctgatgctggtcagcaggctggacaggtggggttcctcaatcccaatgggagcagccaaggcaaggtgcacaacccattccttcccaccccaatgttgccaccgccaccgccaccaccgatggccaggcctgtgcctctgccggtgccagacacaaagcctccaaccacgtcaacagaaggaggtgcagcctcccccacgtcaccaatcctg

SEQ ID NO: 1277 - DNA, 297 bp, Homo sapiens
  misc_feature (1)...(297): n = A,T,C or G
aattccgttgctgtcggtcttgatcttctgacctcgtgatccacccgcctcggcctcccanagngctgggattacangcgtgagctaccgtgcccggccncatattncttaatganaactttnttgaaanccttcattatttctgtgnctttgganttaggnancagagattcataggtaccttnagaanganagaaatntctctacncanatgagtcntccanncctggaagnnataatnnaactgnnctcactactccaanctttaagaagctnnatgangctcattntaaggaa

SEQ ID NO: 1278 - DNA, 289 bp, Homo sapiens
  misc_feature (1)...(289): n = A,T,C or G
aattccgttgctgtcggttgacccgccaaggcagcctcttcctccatagatggatgaacgctgtggccgctgctcctgcctgggccatgccctgatgctgccaacaccactgctcctctatttataagnnttagtacagntgnatgacccttcaatanntgaacagnngatatgttcctnacantaagncnannnctnnatangaatnnntcantgnantnnncataaatatatnccttnncnanatcnanncnttntnantagnnaanntcntttnattnntattctt

SEQ ID NO: 1279 - DNA, 294 bp, Homo sapiens
  misc_feature (1)...(294): n = A,T,C or G
aattccgttgctgtcgagcctgcctgcccccaggtgaaataaacagccatgttgctcacacaaagcctgtttggtgtctcttcacactgactcgagtgaactttgatgccntggctantatattttcantatntnttatnanattatntttncntccttnttnntttttnnnnntttttaaagnntnnttttngntnnttttntttttttnntnncnntctttttntnctnnattntcttcnntatctttnntantncttttctntnnntnntgattnntntnncttttttgat

SEQ ID NO: 1280 - DNA, 300 bp, Homo sapiens
aattccgttgctgtcggcaaacaggtggccatgaaacagatggtcatagaattggttcagtggttgtgagtgcagcaacccaagagtgtcttatctgaaataccaccaggaatgtctggacacagtagacaaagttttttcaactggacgccttaggatacatgcttccaaaaacaaagtagccaaaaagaaaccagagtcacagaatatcagagccaaaggaacatttggaggtaattcagtacctcctccttttcaacctacaggggagatagtggaagagaagcagggatgggtctg

SEQ ID NO: 1281 - DNA, 300 bp, Homo sapiens
aattccgttgctgtcggaagagagcccgaaactaaacagggaggaatccaccatttagaagtctggcaggcaaagaggacaagagagtgtcaatgaagacctcaaagtctggagaaaaatgacctttcatggaataagaagtatacctccttctacatgtttttgtcttactgacctctgataactggaacacatgactctgggtctgtagaaagtcaactgatcaaactcatcctcaccatgcatcaactgttcagactggttttgggacaaaaagatctttcacgagctggggacctc

SEQ ID NO: 1282 - DNA, 287 bp, Homo sapiens
  misc_feature (1)...(287): n = A,T,C or G
aattccgttgctgtcgcagaatcttaacttatcttaatgatatttacctatcctttttgcaactcacaactgactttgtcacagaggtaatgcatctgcttgcaggaagtagctgtaggctcagtacctgttgtttgagtcagatttagcagatttggtttttaagcttgtgggtttgtgctaatttgggcagaatatatttattatatatgtgtgtgtgtatgtgtgtatgtgtgtgtctgcatacgnantacctgtacatagacacacatgcatgtggtcatcct

SEQ ID NO: 1283 - DNA, 300 bp, Homo sapiens
aattccgttgctgtcgccagggctgagaagataaggctacttataggggcgggaagcattgaagctggtttctggccctagcgctcccctgcgatgagatgtgggagccagtgtgtccctgcctgtccatcctgtgcacccccagctttccttgtcacctgaaaccacctctgagggaaggtggtggcgtctcagatgcatgggcatgtggctggtcaggtggcctccatcccagggtgccccgtctgtgtgacctccctctgggtgctgtgggcttgctccagggtgcaggtgcaaccc

SEQ ID NO: 1284 - DNA, 300 bp, Homo sapiens
aattccgttgctgtcggtttcggccaatctgttacctcagtgttgccatcttcattgccaaagcctccttttgggatgttgtttggatctcagccaggtctttatttgtctgctttggatgctacacatcagcagttgacaccttcccaggagctggatgatctgatagattctcagaagaacttagagacttcatcagccttccagtcctcatctcagaaattgactagccagaaggaacagaaaaacttagagtcttcaacaggctttcagattccatctcaggagttagctagccag

SEQ ID NO: 1285 - DNA, 300 bp, Homo sapiens
aattccgttgctgtcgggctgcagttccggctacctgtgtagtccgagtttccacagccaggtactactccgccagtgaccctggacagtaacaaaacatataaagcccgagcccaaaccccgccaccatcatagtgtgggaattttgctgtcctcgtggatcttcatatcttgccacaaggttcaaacaaagatacaagctggttttctgaacagaagaaagaggaagtctgtttactgttaaaagaaaccattgattcaagagttcaggagtacttggaagttcgcaaacagcacagg

SEQ ID NO: 1286 - DNA, 300 bp, Homo sapiens
aattccgttgctgtcggtctcaggccactgcgccaccgcgctggtgctgagcagaagcgggcagaagtggggtctgctttcaggacttcatttcccccactcgttccggccccgcatgctccacgtctgccctttggtctgagttaaaactgcgatgctgaaaagtgcgagctctttccacgaggaggagccacacagggtggcctccgagggtgagtcgctctgctaagcaagggcagtcgctgcacgtcagcccgcaggccaagggtccagcttatcctgggtgctctgtgatcagaa

SEQ ID NO: 1287 - DNA, 292 bp, Homo sapiens
  misc_feature (1)...(292): n = A,T,C or G
aattccgttgctgtcgagaattcggaagaagccgggacccaagcccggatggaagaagaagcttcgttgtgagagggaggagcttnccnccatntnnannttttnttaccatngnctgnnctttcntctacnnnnnntntatnntgngttntttttctttnantcnntttttttttantttttttnnnccnttgttttttnttccttntnttntnttntttntntttnntttnctntttngtttttntantacttttttntnttctttttntgtttattggntttttgttct

SEQ ID NO: 1288 - DNA, 300 bp, Homo sapiens
aattccgttgctgtcggtgaccaaaaggaaagggcaacagcaggagccctgttagtgctgccagaacaccaggaagccttgtgggaggcgtattgtccaagatgatgcgtattgtccaaacgactcagaagaagtcatttctgaagggttgatcataacttccctagccatgttttacctacagagaacttagttagaatttatgagtacagtatgttaaattacttttagtgtaccttaggcagtgtatttgttttgatacagagacaaagactatatgatccctgagacttgttgcct

SEQ ID NO: 1289 - DNA, 267 bp, Homo sapiens
  misc_feature (1)...(267): n = A,T,C or G
aattccgttgctgtcggtttttgtctgggcttgtctagcagtggaattctgcctgagttcatcatttttgtgactggtacttgaagtgcatcagatgattaatttcatgataagagggctttttggcgtggtgaaatagacatttatggaaaatgggatacccacattaagcagggtgactacctgtttaccatacaacccacacaaagccaatacaactatggatgngctttatatantctgntgcctctgcaaacattgaccgtg

SEQ ID NO: 1290 - DNA, 300 bp, Homo sapiens
aattccgttgctgtcgggaccactccagaattggccgctggcggtatcatggcgacccggaacccccctccccaagactatgaaagtgatgacgactcttatgaagtgttggatttaactgagtatgcaagaagacaccagtggtggaatcgagtgtttggccacagttcgggacctatggtagaaaaatactcagtagctacccagattgtaatgggtggcgttactggctggtgtgcaggatttctgttccagaaagttggaaaacttgcagcaactgcagtaggtggtggctttctt

SEQ ID NO: 1291 - DNA, 300 bp, Homo sapiens
aattccgttgctgtcgctgaaagtaagagaaacagactctagctagtttaagctggaaaataaattattaaaactattctgtagctcatagcatctccagcagggctagagagttagccaggaataatgtcccaaaggtcacagccaagccagcctggcagagccaccctggacactgataccactgtttgccaatgccattgatttgggccctgggtggtggcactaagggctcactcccctaagcctctggaaacaggatttggctgtcaccaccctcccagggtgcatttttcttgg

SEQ ID NO: 1292 - DNA, 300 bp, Homo sapiens
aattccgttgctgtcgcaatggcactgcttatctccgaaatggtgtgatcgtctcctcattgagcagcggctgccaccgcgctgtgggtagtgtgtgaccgtggctgtactgtatagtgaacatagttggcatatctttgtttgaagtttgttggtgactccaccaaactggtgtgaaaaaagaaaaaagctcaaaaaaatccacaaaaagacaaaacacacaaaaaaaatcctgcctatattttactcagtttcaaactttattagtctatttttaattataaaaccagaaagctacaa

SEQ ID NO: 1293 - DNA, 293 bp, Homo sapiens
  misc_feature (1)...(293): n = A,T,C or G
aattccgttgctgtcggcagatgacctcaaagcacaactggagttggctcagaagaagctacatgattttcaggatgagatcgtggagaacagtgttaccaaagaaaaggacatgttcaatttcaaacgagcccaggaggacatctctagacttcgcaggaagctggagaccacagagaaaccagacaatgtacccaagtgtgatgagattctgatggaagagantaaggattacaangctcgctngacctgnacgngctantccatgngtaattgganctngntattcatat

SEQ ID NO: 1294 - DNA, 300 bp, Homo sapiens
aattccgttgctgtcggagggcaggagcattcatctctgtggccacatgtttggtccagtgtctgacaaataacattcaacttgtaggaacaagtgatagcagagcatcctttctcaggaacaaggcccatcccctggtgagctgctccactggagtcccaggtccctaacctgtggcctaggtagaccttaggatttgcctcactgatgccaatgagttgctgctgcttacttttgaaacaaagtgttggcatgttccagctgctgcgattcaattgcctttcagacagtgtggtgccc

SEQ ID NO: 1295 - DNA, 284 bp, Homo sapiens
  misc_feature (1)...(284): n = A,T,C or G
aattccgttgctgtcggaggattcctaaggtgtcagcattttgtaaaggtaccacaaaggagaagttgatagggaatctaattttagaatgtgccaaatggtctgtgctcaacaatataattgaactctctcaactctacctcaccatttctttatctcaaaattctgncggctttgtnanaccnncgatntnntntntgnnncnancnngannnncnaancanttacntnngntngccntgtttnntnctcnnnnctcgncgttatntnatccnnncacatac

SEQ ID NO: 1296 - DNA, 300 bp, Homo sapiens
aattccgttgctgtcggtcccgggctcacagtggcacgactgaatcctcagagtcggctggcttttgagctctcacgatgggggaggagggggcgtttctggttcgcagctccagaggattgcgttccttcccccatacctgtcccccacagtcacgctctgccctgacgtgcagcatttgacaagttaccccctcgccacatactacttccacccacgtccgagttaactttgttcttaaccttcttgagactaccctcggcctccaggtctttttttcccagttcatttttgcccata

SEQ ID NO: 1297 - DNA, 300 bp, Homo sapiens
aattccgttgctgtcgggaaaagatgcaccgattgctcttaagaggaaactggagatgaaagccttgagggaattagacagattttctgttttgaatagccaacacatgtttgaagtactagctgccatgaatcaccgatctcttatactcctggatgaatgcagtaaggtggtcctagataatatccatgggtgtcctttaagaataatgatcaacatattgcagtcctgcaaagacctccagtaccataatttggatctcttcaagggacttgcagattatgtggctgcaactttcga

SEQ ID NO: 1298 - DNA, 300 bp, Homo sapiens
aattccgttgctgtcgaaggagtcctccatccagaagggcaatatccgacagagacagaagtgcctggaatctcaaaggcagaacaaccaagaaaccccaaacctaaagttgagcccctgtgccaaggtcaaaggcgaagatgcaaagtcccaggtatgggccttcacatacacccagcagatcctccaggaggagctgtgcctgtcagtcatcaccttgttccctggcgccccagtggttcttgtcctttgcaagaatggagatgaccgacagcaatggaccaaaactggttcccacat

SEQ ID NO: 1299 - DNA, 300 bp, Homo sapiens
aattccgttgctgtcgaacgtacctgtggtccctggatccagtgctactgctacaaataagatcactattatcttcaaagcccaccatgagtgtacagatcagaaagtctaccaagctgtgacagatgacctgccggccgcctttgtggatggcaccaccagtggtggggacagcgatgccaagagcctgcgtatcgtggaaagggagagtggccactatgtggagatgcacgcccgctatatagggaccacagtgtttgtgcggcaggtgggtcgctacctgacccttgccatccgtat

SEQ ID NO: 1300 - DNA, 300 bp, Homo sapiens
aattccgttgctgtcggtcccgggccaggagggtcacagatgcaccacaaggcactctgtgtggcactgggaacaggaattctgggagtcagtctgcaagggtggtgggcgttgctcacctgggagaagcctttagagtgggcgttgagcaggccattagctcgtgccctgaggaggtgcatgggcggcatgggctctccatggaaattatgtgggcgcgaatggatgtggctctgcgctcacctgggcgaggacttctggccggtgccggggcactctgcatgaccctggcagaatcga

SEQ ID NO: 1301 - DNA, 300 bp, Homo sapiens
aattccgttgctgtcgctgaagatcacaataaataaaacagttgctgtcaatacaactccccttattttctctcaagtcacctggatcgtcctgaccccgggaaccccgtctgcagcaccaggccccctccgtggagaaaagatggagccggattaagcacccagtgctaaggcgactaagacgccactgcccgcaggccctgccggaaaatactcagagagtgcagcaggcgccgcgattccttagaaagtgctggcgtggcctctcctgacacagaaagccggctcctggatgcttac

SEQ ID NO: 1302 - DNA, 300 bp, Homo sapiens
aattccgttgctgtcggtgcgccagttcacactccgggtcagagttcctggcccggtgcacctgagaggtcgctctccgactcccgcgctggaccctcttgcgccattgaaccccctgatccgggggcctcggaccccagggctcaggagatggatccagtccctggcgctcctacttcccaactgctcctcctcccgcatccccacagtaccccgtcctcacagcgggctgtgggtccaatcagactttcccctcggattcctctctaggactgaaccaagacttacccgaagttgccg

SEQ ID NO: 1303 - DNA, 293 bp, Homo sapiens
  misc_feature (1)...(293): n = A,T,C or G
aattccgttgctgtcgctgctatcgaactcatcatccttatggaggtcttcaggggccccagagacactgcagagagtgtcagggatttccttccccacaacagaattgctgagggtctgggaagcatggagggaggaagcagaattgcgggaccactggcgcantgnnnggatcangagctatacttcttccngaactgatcnntgntncctgcatnttntgcacnaggnnnnaggatnancttntaatanannctgntgtnnntcctnagnnantnnngtnngttctaagg

SEQ ID NO: 1304 - DNA, 300 bp, Homo sapiens
aattccgttgctgtcggagactgaaataaattgtatagttacttaactaatgaagacatttcagaactctgggatgattttaatcttgaagtagtaggtggtatagtcataaaaccattcatccccttcttgattgtatcttaattttctggctttaaggcgacatctgagaggtaatgcattcttttttatattgaaatcataaactatcacccgctgcttctctgagttacttttaattttgccttgtggttatggtttggcgtttccttctgtttggttttcagagccccatgtcta

SEQ ID NO: 1305 - DNA, 300 bp, Homo sapiens
aattccgttgctgtcggaaaatattagctactcaaataagtaggcttctgaaatagttttaactgcaagtgtgttaacttgtgtggtggtttgaagccatttttccaaataaagttattaaacaccactttatgtactgaagcatgaacagaaaaatcaagagctgagcagaccacctcctttatgtaggcaaaacttccatcattttggcttttgttctaaacagaactaaatgacatgcatagcatggtaacttacagatcgcttaattggagtaaaactcagagtaatagagggaaa

SEQ ID NO: 1306 - DNA, 300 bp, Homo sapiens
aattccgttgctgtcgcatcagccctgctttctcccgctccgtgactttgcatcagttgtcatgaggatgattaaataatttagcacttagccccctgctgtactccttggcctggatcatgaccacaccgaaggagtgcccaccagcaagagacctggagacatccccaattcctgcaagcagaatctgggatgaacagtctgcatgcctctcgccacctgtcccagggattccctgttccacaagacacttgggatctgcttgtcatgcatcatgcgtaactaatagtgcagaggaat

SEQ ID NO: 1307 - DNA, 293 bp, Homo sapiens
  misc_feature (1)...(293): n = A,T,C or G
aattccgttgctgtcggttggaagatacggggataagattgacattgctgttgcagtattgcaaaaacatgactaaattggttaattatggctaccgcttatgtttaagagaatcctttcactaacttaaattgatancattgtngntgatatnnacaatnaatattnntccnaaacnntnanttnacanntatantnnanatcnnnnntnnatanntatntatntntaacnnttnnngccnnnnnntatnttatttttnttcnttnnngannnncngantgncntttcatat

SEQ ID NO: 1308 - DNA, 300 bp, Homo sapiens
aattccgttgctgtcgcagaatattttttaccgaatccttacctgtcagctctgtcttcatcttcaaaagatttagaaacaatagttactcttaagaagactatcagaatctcaccacacagggagagtgaccattctagtctaaataacaaatatttgaatggatgtggagaaatatcagtttcagaaatgaatgaaaagttcacaactctgtgttataggaagtataatgatgtctctgatctttgcaaattagaaaataaacaatattgtaggtggtccaagaaccaagatgacagt

SEQ ID NO: 1309 - DNA, 300 bp, Homo sapiens
aattccgttgctgtcgcagggcctggtgaagcacacaggaggctgccactgtggagcagttcgttttgaagtttgggcctcagcagacttgcatatatttgactgcaattgcagcatttgcaagaagaagcagaatagacacttcattgttccagcttctcgcttcaagctcctgaagggagctgagcacataacgacttacacgttcaatactcacaaagcccagcataccttctgtaagagatgtggcgttcagagcttctatactccacgatcaaaccccggaggcttcggaattgc

SEQ ID NO: 1310 - DNA, 300 bp, Homo sapiens
aattccgttgctgtcgccaaagtgctgggattacaggcacgagccaccatatctttaaaaatgtaatagaatggaaaatggcaaagcgcgctgcttttcatagaagagactatcgcattggggttcttctgttgcccctgcctgtgctgcacgtcctgcttcacagtgtaaagcgcaactcttgctgtgccttattgtaacaggtatagggtggatgctgccatcatgaagagagaggagagctctttgcttataaaattccgtagagtggagaacagggtgtgccggcttaggagaggg

SEQ ID NO: 1311 - DNA, 300 bp, Homo sapiens
aattccgttgctgtcggatggggagtcttgtgttacacgtctggcctcagccacaggtggggtgccggctggtcagcaggtcacctgccaccaggcccttcacctgcagatgggctccatcgcctgtggcctcgctggttaggctaaagggcagcccgggctcctgcgggttggagagctcatagcaggaatgtctgggcccaaccagttctcacaggctcctcaggagacagagcctggacttcgtgtcttagcctcatacttcaggattaggggggcatttgtttaagggtgtataag

SEQ ID NO: 1312 - DNA, 300 bp, Homo sapiens
  misc_feature (1)...(300): n = A,T,C or G
gtgagcctgnanntcnnnttgannctnaaaagcnatggtnngtgctgacgctcaggcttccaggacgggctagatctccaaggggtccataggccctttatctgtgtaagagagtcctctttagcattttccttcagacccccatcccacacacatgctagccgcgctcagagcttccaggggtactagaccctgtgaaaggccatttgggcctggcctttgtgtcgggggcccctcttcgccacacgtcaggtctcctaaccccaccctggccctagcatcttccatcagagactctgc

SEQ ID NO: 1313 - DNA, 300 bp, Homo sapiens
aattccgttgctgtcgatgtattttgattctattaaggaatatgtcatttttatgaccttagactttggtctttgttggaatcctttgaaattggaatatggaagcccctctatcccaccattgtcagtgttgcatatccctagactctcttccagagtcaccctggggctgacttaaattctgggccacaacttcaaatggctgttaacgtttcccccgacccaaaacacacacaccccatgtctgacatctaagcagaaagactgggggttggggaggaagtcttggtgtttttagga

SEQ ID NO: 1314 - DNA, 300 bp, Homo sapiens
aattccgttgctgtcggcagccaggaggtgctgggccacgcggcccggctggcctcctccggtctcctcctgcaggtgttgtttcggttgatcacctttgtcttgaatgcatttattcttcgcttcctgtcaaaggaaatcgttggcgtagtaaatgtaagactaacgctgctttactcaaccaccctcttcctggccagagaggccttccgcagagcatgtctcagtgggggcacccagcgagactggagccagaccctcaacctgctgtggctaacagtccccctgggtgtgttttgg

SEQ ID NO: 1315 - DNA, 300 bp, Homo sapiens
aattccgttgctgtcgaatagagcaagtccagcctgagcctgtggtcggcagtggagaagagagggtcgcagacctgaggcaaagggcagcctgaacaatcaagaaccagagcagccctggcacccgacacccaggagagtgggctacaggaagaggatctgagaccagagcccacagagtctgcagaaactagaggcacaaggcacgaggaatcacaaagcaaacttaagtgccgacatcaaagaaggcattctcaccctgtttcctgcttctgggtttctccacattcctatagcctt

SEQ ID NO: 1316 - DNA, 300 bp, Homo sapiens
  misc_feature (1)...(300): n = A,T,C or G
ttggccccttgggcacctanaagctngctacgcaggactncatcnngacnaattccgttgctgtcgcgttgttgtcttctaaacaaaaaaatcttttccccgggtctctctaccttcgtttttttcctctttacccctcagctcaaaactcagaatcctagacttttgactagctagtgtaactcgttatttacttccactaatgtctcctcccagttgatgcccaggtctatcgagtttgatcttattcttaagagatagaattggggagtagttcttccatccagtattgggtaaccg

SEQ ID NO: 1317 - DNA, 300 bp, Homo sapiens
aattccgttgctgtcgtcacaggagagtctagttgtaaacccgaagcaaggatggtagctaatatcgcagcagtgtttgtaagaggatttttagtttgtcatgcttaaacagacccctcagtattctcacagagaactgaagcaattcattttcaagactaacaagagcacagcatctgcatgcatgtggcaggtatgttagtgaatgttgtgaagtaggtggtcccatcagttgtcatggttcacctctgtccagactgtgattgtgtgactcgcagttggcacttcagcaaagcttag

SEQ ID NO: 1318 - DNA, 300 bp, Homo sapiens
aattccgttgctgtcgtctagctcacaactcgaaacctctgatcatgttctgtagagtacacccgctcaactgatccaatgcaaccaatacagtattggaagctttctacgaacaaggcacccagagagggctcggaggaagatgacagtgccaacgggcacagggagaatcgtgagcttactgcaccttcccagcaggcagagtgagcccgtaggacaagagccccctttctccgtttcccatctgccctgcagccccgaggaacggtccattctacagacaagaggcctgaggctcag

SEQ ID NO: 1319 - DNA, 300 bp, Homo sapiens
aattccgttgctgtcgtagaatttgacgttgtttgggtcaacttcctctatattcatcctgtcccccattccctataggctctaatgtttgtctctggtcacatgaggtaatgtgagttggatgcagttggatcagaaggagtttttgctagaagaaaaataaatcccaaagcacaaactgtactaatgttgggttctgtggtatcatctccatatccataaatcacatttgatttggatgccactggaaatttaatggcttaggaagggatgggtttcatatgcagagtgaaactttaa

SEQ ID NO: 1320 - DNA, 300 bp, Homo sapiens
aattccgttgctgtctagcagtggctgctacagggaattattcacatggcagcaagagagccctggctccctggaccaggacattccctttgtgtgtgttggaatgagagcaggaggagtgctggtcagaagcccctccccagggctctgggacttcagtgttctcagacaaactgggccgctcctctgagctgggatgctgacccacacttggccccggctctggcatccacaggacgctgccttatccgtcatctcgctggggctgggggctagaggctgagcaggtcacactgaaca

SEQ ID NO: 1321 - DNA, 270 bp, Homo sapiens
  misc_feature (1)...(270): n = A,T,C or G
aattccgttgctgtcgtgttacccctcattctgatgcagctcagacaggctgaccagcaagccagcgaggatgaggactgaggctcaatttggagacacgggcctatgtgacctcagggtgcaggcggngggagganttcnctcttatggggntcatgggaacaggggngggngngacttgcttggnggcctcattccatgtgngcctgngcctggggcatggacnntgntaagcanagncagctgngaggnccnnattctncagacgtg

SEQ ID NO: 1322 - DNA, 300 bp, Homo sapiens
aattccgttgctgtcggcaggactcctattggcacagatcgaaaccataatagatactggctcttctcagatgaagttccaggattattcattgaaaaaggctgggtacatgacagcattgactaccgattcaaccatcactgcaaagaccacacagtctctggtgatgaggattactgtcctcgcagtaagaaagcaaacttaggtaaaaatgcaagcatgaacacacaacatggaacagcaacagaagttgctgtagagacaaccacacccaaacaaggacagaacctatggttttta

SEQ ID NO: 1323 - DNA, 300 bp, Homo sapiens
aattccgttgctgtcggcatatcccaagaggacattgccaggatcagcaaggacatggaggacagcgtggggctggattgcaaacgctacctgggcctcaccgtcgcctcttttcttggacttctagttttcctcacccctattgccttcatccttttacctccgatcctgtggagggatgagctggagccttgtggcacaatttgtgaggggctctttatctccatggcattcaaactcctcattctgctcatagggacctgggcactttttttccgcaagcggagagctgacatgcca

SEQ ID NO: 1324 - DNA, 300 bp, Homo sapiens
aattccgttgctgtcgggacatgaaggcctgccaggaggacgatgtgcggctcctgtgccacctcacgccctccatctacacagagtttccagatgaaaccttgaggagcggagagctgctgaacatgatcgtggctgttattgactctgcacagctccaggagctggtctgccacgtgatgatgggtaacctggttatgtttcgaaaagactcagttctcaacatactcattcagagcctagactgggagacctttgagcagtattgtgcctggcagctctttctggcccacaatattc

SEQ ID NO: 1325 - DNA, 300 bp, Homo sapiens
aattccgttgctgtcgggcagcagctgctgggtatttgagctggtctgaaagggtggaggtttccagtgatgtcactctctggcaggattgtggggggtggcttacgccaggtgagtctgtctattggtcctggttatgggcacttattaccaggcagtggcgtagggggtagggcctggagtgaggtggggattttaaagtgagcagatgccagaggtagtgagccaacagcagggctgtgctcttggcccccagcagagcatggttgtatagtatcagctgaggattggttccaggat

SEQ ID NO: 1326 - DNA, 300 bp, Homo sapiens
aattccgttgctgtcggtctatttactgttcttactaagaactatattttaggaggattgctcatccacttgaaggcaaaattggaactgagaagaagagtaaggtagtttcttccctgggtgatccacatctgagacagagagagctggaccaggataggactgaaggaggactgaggctgagagatgcagaaagcgctgtcagggaaggatcccttgagatggcaataggacctctaagtaggcgtgtaacagacaaggggagagcgcccttctccacaatgcagggattttatcatt

SEQ ID NO: 1327 - DNA, 300 bp, Homo sapiens
aattccgttgctgtcgaaaagaagttaaaacgttcccacaggcccctaaaagtcttgtgagttctggcattgtggttcacacatcagatgcccaagttggccctggtccgcagcagaggagggctttgatgggacttagggtatcacaggtgtgctctggctgttgtggggaacagactgtaggcagccagtgtggaagtgcagggacctggaaggggttgactgcactggccctggaaggccctggtaagaggtggtgaggttgaaaataaggttgggggggccgggcgcggtggctca

SEQ ID NO: 1328 - DNA, 300 bp, Homo sapiens
aattccgttgctgtcgccgctccgtggccacaggtccccgcaagaaagaccccgtcccactctctgaggtctcctcccagctccagaaaaggggacattccacctagtctgcccaacaagtaggtctcagccactgtgccaggagctcgggactccctccctccagaggtttctggaatgcattcagcaggaaaagctaaaagaacaggactccaggagataagccaaggccaagtctatcagagggtgagccagcagcgggaaggggaccagcccttcccctagcgttttttctgcccg

SEQ ID NO: 1329 - DNA, 300 bp, Homo sapiens
aattccgttgctgtcggcacagtgtaccgcggggagactgcctccctgctgtgcaacatctctgtgcggggtggccccccaggactgcggctggccgccagctggtgggtggagcgaccagaggacggagagctcagctctgtccctgcccagctggtgggtggcgtaggccaggatggtgtggcagaactggaagtccgcctggaggaggccctgtcagccgtaaaacttgtggggcccccgaagcatcgcttgaaatacacagcttgggcccaagataaagcgtgtaccaatggcccc

SEQ ID NO: 1330 - DNA, 300 bp, Homo sapiens
aattccgttgctgtcgtgctgtgcaagttgtcggttcgtggccttccgtgcagccgcgggaggcaccgcgggaagcaatccctgagcgaggcaatgggtttcgcctcttgtctgccaggctctgcgccctgcgcccggatgacagcagctccgcccgcaccgagatccacctgctcttcgatcagctcatctccgagaactacagcgagggcagtggcgtggccccggaggacgttagtgctcttcttgtccaggcttgccgactggtacctcttaatcagaatcatcttgtcagcaaag

SEQ ID NO: 1331 - DNA, 300 bp, Homo sapiens
aattccgttgctgtcgcgagtttatgatgttacaagtccattttgggagagaactgtacactttttgcaggaccacagaattagtaatttaaatgatatactaaatttgtgtatgggcataagtattacgccttcccaccaggcaatttggactgtctttgaatcctgtctttggtactgtcttggacatgttcttaatatgaacctctgcttcttcatctggatcacactataccccagacttaatgaatttcagtctccaggagtggagcctgaacatatgtatttttagtaagacca

SEQ ID NO: 1332 - DNA, 300 bp, Homo sapiens
aattccgttgctgtcgtccaagccacccccttcccacaacccctgttcctctggggaatacactgtttttgcactttacctccctaccagcagctctttccagattgcaggggcgagctggtgggaagcttgcagattgtttcgcactgccgtgtaatctgtgtgcttgtcactggggtctgttcttccttgagttggtacagtgaaatatgcattgagagtcccagggcagtcattgccactgtactttgtgggctggcttgccttctttattatttcttctttaaaataaaagaaaat

SEQ ID NO: 1333 - DNA, 300 bp, Homo sapiens
aattcgttgctgtcggtggaaccggccccactaacctgcatccagctgcctcttccacctgggccctgctctcagatggaagtgtcaccaaacacccagatcgccgtgctcctgcttctctggagtggacacaacctgaaaaccaactggactgagcatccttctcctaaaatctcagccagaagccacgatggagggtcctgggaagggaagagatgtgaagatttctgtgattctaaaaccttgggtctgcctgcaaacttctctctgatcccagccgagagctgtgcacacgctagc

SEQ ID NO: 1334 - DNA, 300 bp, Homo sapiens
aattccgttgctgtcgcagaaagtgcagttgacagaagggtcacgttcacactacaatatcaattgcaactcaacaaggactccagtcgccaaggagcttaattataatctagacactcatacgtctactgggaggatcaaggcagctgagaagaaggaagcgtaatgtagaaagcaacagaaaaaaggaaacggaacttcttggctctttttctaaaaatgaatcagttcccgaagttgaagccctgctggcaagattacgagctttataagttaaactggtttttaaaaaaaatgatt

SEQ ID NO: 1335 - DNA, 300 bp, Homo sapiens
aattccgttgctgtcgaaaaaatctgtagcaccgggcatggtgcatgcctgtaatcccagccactcaggaggctgaggcagggaggatccattgagcccaggagtccagcctgggcaaaatagcgagagaccctgaatctgaaagtaatgataaaataaaaagaatataaatgaggtctcgttgatgctggacaattcaagaattcagacttgaaccttaaacctaggaaaagttactttgtatcaggattctaacaattatgcttcatatttgtgaagtcctttaaaacataattttct

SEQ ID NO: 1336 - DNA, 300 bp, Homo sapiens
aattccgtctgctgtcggccctcttcactgcagtggggtggcagcagcacctgctcaggaagttggtgggcttcgctgggcgcacacggcccacctggcactcaccagcctccgggctgcccttggcaggtgccgtccacactccagcactcagggaggggcggtgcacatcctcaaaaactgaccacactggcactggcgcccaggtggtgagtaggcgggctgtggtctgcagacagaagctttaccctgtgcacatacgaggagtaactcatttgagtgacgtcactggactgcggc

SEQ ID NO: 1337 - DNA, 300 bp, Homo sapiens
aattccgttgctgtcgtaaaacttaaatacattacacgggttgtaaggacaaaggattttaaaatctgagcacttaggtgaagggacaagcaggtttatgtgtttaaacagaaagaagggaaaaggtactatgtgatatggtactgaaattttgatcccaatagaattcatttctcttacgttgaatccccaatcataattaagccgtatacacagattaaattaacagaagcatttcacataaatgttggtttcagtcatcaactacccatgaattcctgcccaaggatacttaatcag

SEQ ID NO: 1338 - DNA, 300 bp, Homo sapiens
aattccgttgctgtcggaaagttcgacacagcaaactggctgagtctgtggaaaaggccattgaagagaaaaaataccttgctggggcagacccttctactgtggaaatgtgttaccctcctatcattcagagtggtggcaactataatctcaagttcagtgtggtgagtgacaagaatcatatgcactttggggctatgacttgtgccatgggtattcgcttcaagtcttactgctccaaccttgctcgcactttgatggttgatccttctcaagaagttcaagaatattataactttt

SEQ ID NO: 1339 - DNA, 300 bp, Homo sapiens
aattccgttgctgtcggttgtcacatcctgacagggtttcttataaggatttctcttcccttgtgttagaattacagaggatgaaagtattttaaaatctctgttgctgaacagggacatgtgctaggcagcctacaattgtcagttttattccataggtacgttagtggtcagaatgacttcttttttgatggcacaattattttcataatattagattgaattaagctggtgagacaatctgaccctaaaagattcagaaaatgacgctttgatgttagctttgaagcagggtattcc

SEQ ID NO: 1340 - DNA, 300 bp, Homo sapiens
aattccgttgctgtcgggattttccaagataatctacagccttttacgccatctcttgttcctgttaagtcttcaaataatgtggcttcaaagattttaaaaacttttgtagataggaaaaatttgggagataatactataaatatgccaccattgagtaccatcgatcctagtgggacgcgatccaaaaatatgcctattaaagataatgctttggttatgtttaatgggaaagtctatctgttggctaaaaaggggacagatgttctgccatcacaaattgaccaacagaattctgtt

SEQ ID NO: 1341 - DNA, 300 bp, Homo sapiens
aattccgttgctgtcgaagacctttatcttgctttcagggaacttgcaggtaaccaaacagataagacttgatggatgaaataaccacagtcagtgctagagttaatggtgtatgcagtaagggtgaaataaaataatgaaagcccataggtatttctaagggggctttctagattctacgattgatctttcatattttctaccttccactttacaaagaaaggcacattagccagacatcccaaatagtacattgtggtgagaggccttccacaccaccagagagacaaatcagaatgt

SEQ ID NO: 1342 - DNA, 300 bp, Homo sapiens
aattccgttgctgtcggacggggttctcaccatgttggccatcctggtcttgaacttctgaccccaaatgatctgcctgccttggcctcccaaagtgttgggattacaggcgtgagccactgcgcccagccttgaggtagcatactttctgaaataaaaaagtagattatgtccgaagcagttgacctaaaaactgccttggactgacatttgttaggtggtctaagatgttctcttcacgctttgcaaaaaaatgagcttttttggagtttaaattaagcatccctctggtgtgtttgg

SEQ ID NO: 1343 - DNA, 300 bp, Homo sapiens
aattccgttgctgtcggtgaggagaacatggatatggatgtaatgtccttcccttttgttttctttgcacaaatttcagtggaaacatgttgccaagtcagatcgccattctacttgagtgaatatggaatttgtccagttttccaaatgcagagctttttgtgggctgatggactgaatagaaagaggaacaaccatacacccttctacagatgaaggcaagattttatgaaagcgacttcattcgttctcctctgcctggtgttccttctttgtaaaccaggaccagggagctttgaa

SEQ ID NO: 1344 - DNA, 300 bp, Homo sapiens
aattccgttgctgtcggttgagcaggccattagctcgtgccctgaggaggtgcatgggcggcatgggctctccatggaaattatgtgggcgcgaatggatgtggctctgcgctcacctgggcgaggacttctggccggtgccggggcactctgcatgaccctggcagaatcgagctgccctgactatgaaaggggaagaagagcatgcctgaccctccaccggcaccccacccctcactgctccacctggggcctgcctctgcgggtggctgggtcctggctgactgttgtgactgttga

SEQ ID NO: 1345 - DNA, 300 bp, Homo sapiens
aattccgttgctgtcgggaccaagtgctctcaaaggtgctggcagctgaagagcgtgttaggactctgcaggaagaggagaggtggtgtgagagcctggagaagacactctcccaaactaaacggcagctttcagaaagggagcagcaattggtggagaaatcaggtgagctgttggccctccagaaagaggcagattctatgagggcagacttcagccttctgcggaaccagttcttgacagaaagaaagaaagctgagaagcaggtggccagcctgaaggaagcacttaagatccagc

SEQ ID NO: 1346 - DNA, 300 bp, Homo sapiens
aattccgttgctgtcggggtggtgaagggtgcctcttccatggtgttcccatgtttccattcttcttcctgactccagggccacttgacccctaagggcccttctttcactctggtctttcagagtgtctcagccttcacttccctttgtgtctctagaaatttacttacactcattattttccatctgggtttgagattgaacaggttcatctcccccattactgccaacccccaaaagcctgggtttctggagcgtccctgcctttttcatttttgcttccagaaaccatatacagct

SEQ ID NO: 1347 - DNA, 300 bp, Homo sapiens
aattccgttgctgtcgacttcctgaattactgacccaagccaaacagaaacaataaccctcgagaaaataggtcaacaatctgttgtggggaaaccacctccatgtaacccactggatacagtccccttaatgtttttgcttctaaattgtaccttttgcttctgatttcttctcccctgctgtttcctgcccatcagagaggcctgatacaagcaagtttgtttacatccctggggaatcttttacatcaaacttttgggatccaaatccatctccttttaaatttcaatctcagcacc

SEQ ID NO: 1348 - DNA, 300 bp, Homo sapiens
aattccgttgctgtcggccttttaatagttccagtgaggtgagagctggatgaggtgggtacaacagaatcatcaaaaatctggccgttgatgggacctcagagtcacttgaggaagcaacatttgagcagcatctaggagccttctgggaaaagatggagaaaactaaagacgttaggtttattgcaaaccaatcaatcatactcactgatcacctactagaggaaacctgtgataacacttgtggggagatttatagaaagaagacgtatttgcacatcaggattttacatcatgatg

SEQ ID NO: 1349 - DNA, 300 bp, Homo sapiens
aattccgttgctgtcgttttcgcttggctactcagattttactaaagcaggtcacatggccagcctgtatttaacaggccaggaatgtataatcctgttttcagagagaagcaccaaacacaaggaacaataacaaagacactgtggagtgtcctaagaggcttggagcggtcataaaataaaactgtacccatgaatggatgaccatgtagatgggtcacctctccttgcgacctaactgaaaccacagtagaaccacagtagaaaccacctccaagtgaggttcctacaagttctgtc

SEQ ID NO: 1350 - DNA, 300 bp, Homo sapiens
atttgctgggggcctcccgagcctggagactgagtgacccacccctcctgcctaagggacgctatcttcaagaaccggaagagaccactcccacccccaccccgcccctgctttcgctcttctctgcaatggggtctccgaaaggagaagactgcagccctgtgaccctggaggtttgcgctctcctatgctgtctcaaaaaactgcctccttctaggcaagggcttccaaaccctcatcctgatctcaccttcagccttacccgccagctatgatccactcgactgtgaacttaaactc

SEQ ID NO: 1351 - DNA, 300 bp, Homo sapiens
aattccgttgctgtcggaagatgcaaagcttcatgggatcacctcaaggcaattgcaaaacatgaaatgaaaccagttttaaaacaacggatgtcagagttcctgaaagactgtgcagagcgaattataattttaaagattgtccatagaaggataatcaacagattccactcctttttactctttatgggccatccaccttatgcaattcgggaagtgaacataaacaaattctgcaggattattagtgaatttgcactagagtatcgcacaaccagggaaagggttttgcagcagaaa

SEQ ID NO: 1352 - DNA, 300 bp, Homo sapiens
aattccgttgctgtcggcctgggaagatatatgtctgattttcggacttggaagcaagataaaggaaagaggctgctggtttatggtatagagattttcactcgttaagaaagtaacaaagtaaggaagtaggattattgtagaaatattattttacagttcaagtttgtaaaacacaggtgaaggtaatcgttggtgggtctcttcctctgagatcaccaaattatctgtagactggttggtagacttggagagaccacttgttcttggacaacagttagaagcatactgccctaagca

SEQ ID NO: 1353 - DNA, 300 bp, Homo sapiens
aattccgttgctgtcgattctcacgtgttgttcccctcccgttctccagtggcaggacctccacctgaaggagaacgtccctccttcccttttgctcctgtcccgcaccttctacctgatagatgtgaagcccaagccgattgagataccactcagtggggaggctccaaagactgatattcttgtggaattacctactttcactgaatctaaagagaacatggtggatcttgcacctcaactgaagggaactaaggatgaagactttatacagccgccaccagttacatcatcacccat

SEQ ID NO: 1354 - DNA, 217 bp, Homo sapiens
aattccgttgctgtcgcacaaacaacaaaaggattaggacagtccttctgaaagcaggggtctcaacatcaaatgtgacaacagccatacaggctttacaaatatgtagactggcctagtataagagaacagggagtgggcacatatttagcgcattgcaatgggcataaatacctgaagttacttgacccgtggaagagcccttgacagccatata

SEQ ID NO: 1355 - DNA, 300 bp, Homo sapiens
aattccgttgctgtcgtagaaacctagatagccaagtggaacctgcaatcaagaatgaataagaatgaggctatagtgatgaaagaagcaagtaggcaaaaaactgtagctttaaaaaaggcatctaaagtttacaaacaaaggcttgaccattttacaggagctattgaaaagcttacttcccaaattagagatcaggaagccaggttgtctgaaacaatttcagcttccaatgcctggaaaagtcattatgagaaaattgtaatagaaaaaaccgaattggaagtacagattgaaaca

SEQ ID NO: 1356 - DNA, 300 bp, Homo sapiens
aattccgttgctgtcgggacttgtaagaggacatggcaacctgtgagcccagactggatcctggaccagaaaaaggacactagtgagacaactggcagaatttgcataagaagcacggcctcggcctcgggtggtggagtcactgctgagcccatgacgttctgcttatattccatccctgcatttggaagtcgttctttgccaggaggaaagtgaggaaaaaccagcaataacaaaacagcagctctactgacggaggaggaggagcccaggaggcggctggtcagggcccaggtgtgg

SEQ ID NO: 1357 - DNA, 288 bp, Homo sapiens
  misc_feature (1)...(288): n = A,T,C or G
aattccgttgctgtcgattgactccactttctcaaggaacacaggagactaagacaggcaaagatgcagcccagggagggaccatgtgggggactggtctaggtagtgagtccccacttggagcctctgtgatcccagaccatcatggaggagcagctggtactgaagcgggtggccaacatcctcatcaacctgtatggcatgacggccgtgctgtcgcggnccatccgntccatccgtattggctccgcaaccacgaccacgangttacttgtncnanaccttttg

SEQ ID NO: 1358 - DNA, 300 bp, Homo sapiens
aattccgttgctgtcgggctgaaaggcctacagattaaaaactaacactgcctcccctgcagtgagatagtcctttcattttagctccttgcattgaaatagcattgaggattaaatttgtgtaagccccacaaaattcaaaatttatgtgcttttctgaccacttgccttctagtggaaattttaagcatattagaggatatgtttctgtgggagctgatcagaatggtactaggagtacaaaagaatatctaaaactaaaacacagctatatttcagatcatactgcttcatcacatc

SEQ ID NO: 1359 - DNA, 300 bp, Homo sapiens
aattccgttgctgtcgaaaacatctattctgatgtcagaggactatctcagaaccagcaaatacctcaaaattctgttacgcctaggagaggaaggagaaagaaagaagttaatcaggacatactagaaaacaccagttctgtggaacaagaattacagatcactacaggtagggaatcaaaaagattaaaatcatctcagctgttggaaccagcagttgaagaaactactaaaaaagaagttaaggtttcatctgttacaaaaaggactcctagaagaattaaaagatctgtagaaaat

SEQ ID NO: 1360 - DNA, 300 bp, Homo sapiens
  misc_feature (1)...(300): n = A,T,C or G
aattccgttgctgtcggtgccactgcactccagcctgggcgacagagcaaggctctgtctcaagaaaaaaaaaaaaaaatcancntttttaaanccgatntactttntatgttnccntanntgggnaanacagnaatgagngggtnaaggcattgngtcnaaaanatgnggggnnancctgtngnacttgaangnaatcnttccntaattttnccncntaaananggnattaatanccagcnccacncctgngaggaaaaattttgnaangccccntntttacgggaaaatttaaaaaaa

SEQ ID NO: 1361 - DNA, 300 bp, Homo sapiens
aattccgttgctgtcggtatgattgagggaatgctgggaatgtgtgtaaacacatacatatgttgtcatgtgttaccttaattgacctatacagttcttgagtacaagattaaaacctgtttctgagtatgtgattgtatcaatgagggctctttctgatgtaaattttgagaaattcaaccttagttgttttaagtaagtaaaaagaaggtttattgatcatctgattgaaaaacctaaggcagggctagctatagatggttcacttgggccagtttcttccccagcatcctccttcat

SEQ ID NO: 1362 - DNA, 300 bp, Homo sapiens
aattccgttgctgtcgctttagcagatcatgtctctgctactcgaatcttgtgtggagcccttgtctttcctactattgctacaatagttggtaaattgatgttcagtagtgttaactctaatttacaaaggacaatcttgggtggaattgcgtttgttgccataaaaggagcatttaaagtttacttcaaacagcagcaatatttacgacaggcacaccgcaaaattctgaattatccagaacaagaagaagcataaaactgacttctggttgttctgcagttctctcatccttatgaa

SEQ ID NO: 1363 - DNA, 300 bp, Homo sapiens
aattccgttgctgtcgcaggaagtagccgtgtctagcgctctacaagacacataggagaggtggcatccatggccctgaaacgacaagcccatgttgccagcgcattatcaccaagtcacttggcaagcgtttagcagactactggtgcctggatgatctgtaccgggagatggtgagatgctatgtggaaatcgttgagaagcttccagaacgccggccagacccagctaccattgaaggctgtgctcagctaaagcccaataactaccttctcgcctggcacacaccgttcaatgaat

SEQ ID NO: 1364 - DNA, 300 bp, Homo sapiens
aattccgttgctgtcgttgtccttttctaatagttcgtgttttagaaattcagaacaaacaatttctgaatgctcctcagaacgccaactcaggcagagaatctcaccgaaatagagaagaagctcatgctcctggaagaaacagcccgaggagagccgctgggccacatctggccactgtccgcagcgctgtcagattgctggggccacatctggccactgtccacagtgctgtcagatccaaggagagccgctgggccacatctggccactgtccacagcgctgtcagatgccgacca

SEQ ID NO: 1365 - DNA, 300 bp, Homo sapiens
aattccgttgctgtcggatgaggggtcctcagctcggtcaagaatgttgcgtttcccttcggggtccagctctcccaacatccttgccagctttgcagggaagaacagagtatgggtcatctcagcccctcatgcctcggaaggctactaccgcctcatgatgagcctgctgaaggacgatgtgtactgtgagctggcggagaggcacatccaacagattgtgctcttccaccaggcaggtgaggaaggaggcaaggtgagaaggatcaccagcgagggccagatcctggagcagcccct

SEQ ID NO: 1366 - DNA, 300 bp, Homo sapiens
aattccgttgctgtcggtgcaatgatggctgggggaatcgtcatgactgccaatctcaacatcaattataaaagacctatccctctttgttctgttgttatgataaatagccaacttgataaagttgaaggaaggaaattttttgtttcctgtaatgttcagagtgttgatgagaagaccctatactcagaggcgacaagcttatttataaagctgaatcctgctaaaagtctgacataaagagctgctggtgaactccatctcattctcgcccctccagaagaagcagttgtcccccaa

SEQ ID NO: 1367 - DNA, 300 bp, Homo sapiens
aattccgttgctgtcgcacatccctacaaagcaggaaagtatgcttgggagaggccaagtgagtggggaatcagcccaaagccaggcgtccagggtctccctcacctgaagctgactttttccccaccttggacagagggcgggagatgccatccccactgaacccagtgctttcaccagccatattagctcccactcaccccccgtcgtggaagcctcggccgtcacacctgcagggccggggcgtgcatggcctcagggatggcctgttcagctgctgggtgactcgggtccaggtgc

SEQ ID NO: 1368 - DNA, 300 bp, Homo sapiens
aattccgttgctgtcggtgcaagcgagcctgacgctgtccacgtcgtgctggaccgccacctggtcacaggccagaatgccagctccaccgtcccggccgtgcagaacctgctcttcctctgtggcagccggtgagggcaccagggtgggcacattcctgccacatcagagctgcacccggtgcttttgcccaagctttgaccacacgtctgtcctgcaggaaatgaacctgctgggtagatgcaccccctgagacagcccaggtgtctccagaggcagccccgtctcaggcttcaggga

SEQ ID NO: 1369 - DNA, 300 bp, Homo sapiens
aattccgttgctgtcggctttcgccatcttcatccctacttactgtgcttccgctcccttgggtcccaggatcccactccttcgatgaaactcagtcttccatctctgcctggtgcttctgccctggtttctgctcaactcggcgccgtgtctctgttccccaaagttctgtttctgttctgtgctgccccctccccctgcccccgttttctcttttttaagagacaaggtctcggccgggcatgatggctcacacctgtaatcccagcacttggggaggctgaggcgggtggatcactg

SEQ ID NO: 1370 - DNA, 300 bp, Homo sapiens
aattccgttgctgtcgcagtcttcctctttgtctcatcagactgttatcactgagggttagatgagaaaatctcaaggctgtctgtctttcctaggccagctcgctggcacaaagccaagaaggttcagctgacccctggacagacagaggtgaagattgacctgccgttgcccattgtggcctccaatctgatgattgagtttgcagacttctatgaaaactaccaggcctccacagagaccctgcagtgccctcgctgtagtgcctcggtccctgccaacccaggagtctgtggcaac

SEQ ID NO: 1371 - DNA, 300 bp, Homo sapiens
aattccgttgctgtcggcagtctgtagtctcgtaggtgctgtgtcatatctgctttctgtttggagctcagaattactttttaaggaattactttttaaggattaaaaagatttgtggttgcttcgtggctttgagaagacagtagagcattttcaggaattaatgaaggggagagatggctagaggagagggtgagagagacttgagttcttggctatgactatcaggtaaccaaataaaatgccctgtggaaatggggaccactgatggaccacaggcatgctgcacagttgatagct

SEQ ID NO: 1372 - DNA, 263 bp, Homo sapiens
  misc_feature (1)...(263): n = A,T,C or G
aattccgttgctgtcggtgaatccaaattaagggatagtccacaaaataactgacaatattctttagaagtgtcaatgtcatgaaaaaacaaagactgaggattcgtcccagattgagagactaaggggccacgaggactaaacacaacatgggaccctggactaggaaagggtggtgagtgggacggncannnngggtgagagggacngaaccanggnnnnnngcnatgcnannacggnnnnnnnngcgggncnnanaannc

SEQ ID NO: 1373 - DNA, 300 bp, Homo sapiens
ccatcgattcgaattccgttgctgtcggcatgtcccggtggacaggtgtggaagggactgaccctgccaccccgcggatctccccaggcttctgagttgctggcggttttccttccaactgcagtcccgcagtcctctcagccatgggccacacccccgggtctcagaccccgtgtttgttttcatgccaggaggcagctcagggaaggtcaggagatggggtgttcccagtcatgcccatggcatctctgcctcctcgggccccacctgcctcgccctgtggcctgagtcccttcagct

SEQ ID NO: 1374 - DNA, 300 bp, Homo sapiens
aattccgttgctgtcggtcagaagttttgtttaattctatggtatttctaaattgacttgtttaaataaattcagcaaatggatagcattgttttttatttgcttcaatatgggggtagataatagctaaagagccaaggatgaatttcttcaaatgactttattctgttagctttacataggtgttggaggattcctaaggtgtcagcattttgtaaaggtaccacaaaggagaagttgatagggaatctaattttagaatgtgccaaatggtctgtgctcaacaatataattgaactc

SEQ ID NO: 1375 - DNA, 300 bp, Homo sapiens
  misc_feature (1)...(300): n = A,T,C or G
aattccgttgctgtcgggtaatgaataatttatggacactgctggacctcagtctcctcatctgaaagatgagtggttggagaagtttaatggttttcaaatgctttttttttcagncttcaaataagngtttacgcngaaggaccttntntganntgntntttgtaaacnnnnnnntnngnttttntnccggnnncnnacnntnggncccccttnanaatnnncnntttnggtttnnaaatgagggaccnntgaanggnntnaaaatnccnangttacnnttnacnanntnaaggaatt

SEQ ID NO: 1376 - DNA, 300 bp, Homo sapiens
aattccgttgctgtcgctacactcagcctcattcagtttacagcatggaaactgtataggacctctttcctatagaaattgaagacacttaaataggaagaaaattaaaatatacatttggatacatgagtattccagtcaaataatatctataaaataccagatagagtataaaagacaactgaaggacaacagagtgatgaaaggactttattaggcatttggatttggttatgatttaaatttcaatttaattagaacgtttccatggcaaggaaggaagcatggaggactgtggaa

SEQ ID NO: 1377 - DNA, 300 bp, Homo sapiens
aattccgttgctgtcggagtgacctgttctcctgagtgctctagtgtctccagttgtcggggggaaagatgatggaggggaacagaaactggacttgatgtttgcggtttgagaggcaagaaaataaaataactttctacctctaaattgaggcttaggagtaaaaagcattttgtcctaaatttatcatttaaaatagcatcagtaacttttgagctcatgtcaatcaagcattggcagtcagagattttatagggaagactaagtaaatccagtttccaagaacctaaactgattgag

SEQ ID NO: 1378 - DNA, 300 bp, Homo sapiens
aattccgttgctgtcgcctggattcaagtgatcctcccacctcagcctcctaaagtcctaggattataggcatgagccactgtgcctggccccctcatctgatagaaaattagattttgctatgagccatttcctgagggccaatttaatactcgtgtgactcttcttagagttaccatctgccttaaatttcctctgtttttcacattcttggaaatatatcattgttttgcaaatttctatatctaattcagggtttaccaggagcttaataattaatggctacatagcaaggcatcg

SEQ ID NO: 1379 - DNA, 300 bp, Homo sapiens
aattccgttgctgtcgaaagaaatcaacaaggcagtaattagtaaatataaaatcctacatcagccaaaaaagtctatgaattctgtgaccagaaatctctatcacagatttattgatgaagaaacgaaggataccaaaggtcgttattttatagtggaagctgacataaaggagttcacaactttgaaagctgacaagaagtttcacgtgttactgaatattttacgacactgccggaggctatcagaggtccgagggggaggacttactcgttatgttataacctgagtcccttgtga

SEQ ID NO: 1380 - DNA, 300 bp, Homo sapiens
aattccgttgctgtcgcttctgttcctgatccgactcattcctttctaggtctgtgctgattgtcctagccttggggctccccaagactctgttcttgccactgaggctacttcttcctgaggaaaaataaatgataacagctgataagggcaggccatgaaaaaagagcagtcctagccaccccagcaccatcactggcaggctcccaggtgtaccctgcatcacaagagcttcccttcttcctatttgctgggagactaatcctcctcaataattctgtttagtatttacagtttttt

SEQ ID NO: 1381 - DNA, 300 bp, Homo sapiens
aattccgttgctgtcgaagaaatcctgcagctgaaacacttctctccaaatgtcgagcatctttatttatccaaatctctccacagtgtttgtttaaaggggagcgctggagagtaaactaaatcttacaatgagcatatggatggctataattgctgaggtttgtttttttttttcatatttgctaactcgctatatataaaattgggtttctattttatagatttcacaccctgaaaactgctaatttttgcatgcatatgattttcacatgaatggatgaaaatactaaaatctctt

SEQ ID NO: 1382 - DNA, 300 bp, Homo sapiens
aattccgttgctgtcgccgggcctcaggctccttcctactgtccgagggccaccaggccgccgggggcctgctgcgcccggatgcgtctgttactagagtggagagtctaccttcgtctcacatgtgccacaaaggatggcatggcccgggagtgccccaccacgtggctttcaccccctgcaaagccagacttcgcccagcgacacagtgtcaagcccacagctctccaaggaggaagatggtccaggctgggagcatccccttagcagcagcctctgatcccttggccaagcaggagg

SEQ ID NO: 1383 - DNA, 300 bp, Homo sapiens
aattccgttgctgtcggttttgtaggatcactgggatattttccacaacttcctcttctctagcacacacatctgttgataggaaatatttgagggtttttccactaccaaatgggagcttcatggtcctggtgtcaaacactataaacctttgaccagctgagctgtgactgctgtcacatatctgagtcctgtgtgcacagtaatatcctgggtcaggtaaaatccaggtcttcaagttttaaggattttttgaagaattcgggcttctttaagacgatccatgcccaaatccacaag

SEQ ID NO: 1384 - DNA, 300 bp, Homo sapiens
aattccgttgctgtcggctgaggggcttttgaaaaagagggtgccttactgtgccccagaccaggacaatcagtatttctggggaatggagcctggcacacacacatttcttaaagctcccttggcaattctgaggagtggattacatgttgtatgtagctcgtaacgaaagaaatcttgtctttgctctcagacccccatttcttactcatctcatgagctccttcgagatccagaaacagttgcatatttcattagtaaatcagttccagagtcacattttatttcacaagttagtcc

SEQ ID NO: 1385 - DNA, 300 bp, Homo sapiens
aattccgttgctgtcggtagtattgtaaaaatgtatctatatgttatcctacactaagcctaagctttaatgaggatattggtacctgactgtcctgtacttggagcatctgtccacttttgaatacatgtaacactttgatgctcctgtccccatggtttgatgaagtacttaataccttgaatgctatatttattatcaaattttgaatgaaatcactagcctaaatacaagtgagatgtttttgaaattttcatcacctttgaaacacctagtatttctgtagaattggattgagga

SEQ ID NO: 1386 - DNA, 265 bp, Homo sapiens
  misc_feature (1)...(265): n = A,T,C or G
aattccgttgctgtcgctgggctagaacctcagtctagtgttcaaaggagctggcagaatgggttgtctcggcatggaggacccaaaagcagagctccctggtgctttgggggagagtgaagcccttcattccactcctcattgcagaccagctttcctggtattcatgcactgctttttgtaacgcctcaaatgaaagccacagctcagccaagtagaagagagctcctaataaatgaantcnggntgcctttgaatnnttnac

SEQ ID NO: 1387 - DNA, 300 bp, Homo sapiens
aattccgttgctgtcgatttcattgccctctttagaaatttgcttgatcttgggtcttgttcagggcagaaagagataatacaaggctttggtgatgcttagcattttagaagaagtaatgctgggtggaaatggatttggcagtctcgtttttcgcatcattggaatgggagtccctcacagttggagacaggatgaagtaacagagcgtggggatctggattaacaggtggccattcgcagaaaggaggctgcaaagcaagaggtgggggcttctggctgagcaggaaggtgggagag

SEQ ID NO: 1388 - DNA, 300 bp, Homo sapiens
aattccgttgctgtcggtttggtcttaggctaaaatccatgttttacggagaattcaagaaatttttaaacttcaggtagaactgtgttttttacaaatgtatagaaagcatagtgcctaatgcatggtagaaacatttctttaaggatgaccggatgttgccgtatgtatttatggcacaagcaggtgttgtctaagcagtttctctgtttgcttgtcatagcagcatttggaaactcaaacatgctttcatttacataaatagtttatgaagctttgacaacaaatgtaaacagacac

SEQ ID NO: 1389 - DNA, 300 bp, Homo sapiens
aattccgttgctgtcgggggtcttagttttcaaactctggcaactctgtgaaaaataggagcaaactagagagccctggagattggtagtagggaagggaggatagcaggaagtttgaaaaattagcagccccggggcctaaaggaatcagctgtcatcattttcatcattattattttggttaggatggcttgaaaatcagaacgtatcttggtttacgtaattgaggtcttaaagaactaagaacagttaaatagtcacaactaccaccctctgacttacataatcattggtgtgggc

SEQ ID NO: 1390 - DNA, 287 bp, Homo sapiens
  misc_feature (1)...(287): n = A,T,C or G
aattccgttgctgtcgcattgcactccagcctgggcaataagagggaaactccgtctcaaaaaaaaaaagaaccntagtcgtcngggaanacnttantgcananacntgtgagngganacctganggaantgaanaggnaaggagttgtgctgatatntaggaggaggantnttccaggcanacggaaaanaggcccaaagtntttgaggaaggggcntgttggccntgttcacaggacagcgaggaggccaaagtgggnggagcaaagatcccagggggagaggca

SEQ ID NO: 1391 - DNA, 300 bp, Homo sapiens
aattccgttgctgtcggccccgagtcatttctgaccaccccgttctgtgtcctcactcttgtccctgaatgggtccctgtgtggatctcagtgtgtgtgtggtttctccactcctccccgctcatgtcccacacctgccatattgaaccgtttctgcactaatcttctccacgggcacggagtggagggaacgtcttgggaaaggggagagcttgacctccatctaggtttcttttatctggagaaaaagaacacttttgaactatgtaatgcttcgccctgaaaggcaagctaacgcta

SEQ ID NO: 1392 - DNA, 300 bp, Homo sapiens
aattccgttgctgtcggttctctgctgtcacagcctttgttaccttccgagccacccgaaaacctctagtacagacaaccccaaggttggtttataagtggttcctgctaatctataaaatcagctatgccactggcattgttggctacatggctgtcatgtttaccctctttggtcttaacttattattcaagatcaaaccagaagatgccatggactttggcatctcccttctcttctatggcctctactatggagttctggaacgggactttgcagaaatgtgtgcagactacatgg

SEQ ID NO: 1393 - DNA, 300 bp, Homo sapiens
aattccgttgctgtcgtatacctctttgttatgatactgataaattgtgatcttgcagtcgatcactgattttctgtggtcagaggattcattattagcctcttcatggattctatcttctgaaacccttttttctttcttttcattgtgataaaaaaatcagcatatatgtgactaatctaaatgagagattgattgtgtgagaccactgaaaacaagcatatgtgagtgattccatactgatttttgttttaaaattgagcacgttttaaaaattttgtaaggctcggcgtagtggtt

SEQ ID NO: 1394 - DNA, 300 bp, Homo sapiens
aattccgttgctgtcggggtgagagagatggtgttctggacacttccccttggtgccatcatccctgctcctcctttccttcctctccccttcccatgaatgtggggcttgatttgttttaccccttaagtgggctgaagatgtaaagcttaacctcttccaaactagatgctttgaggttccagctgtcactgagaacagcttggtagctggtgcagcgtaccagcgtgcagaggcagcattgttcagctggagcctcactgctggagcctcatctaccagagggctccttccatactg

SEQ ID NO: 1395 - DNA, 300 bp, Homo sapiens
aattccgttgctgtcgggaacactaatggccctccctggaacagacacggcgcccccccacagaatagcctcgatgccccctggaacagcctcggtgccccctggaacagcctcggtgccccctggaacagcctggtgctcctggaacagacacagcccccccagaacagacacagcaccccctggaacagcctggcgcttcctggaatggccacatccccccatcctttctgtgctgctttaggcatctgcccttacgtggttcgtgtccagctctgtcaacaaggccagctccacaag

SEQ ID NO: 1396 - DNA, 300 bp, Homo sapiens
  misc_feature (1)...(300): n = A,T,C or G
cacctcttgttctttttgcaggatccntcgattcgaattccgttgctgtcgaagtttatgtatattttaaaatattattaaaggaggtttgaaagtattgacatttaaaaagtcaacacttagattaaatttagctggtagttttaatttgggttttagttaagagtgtgaggacatcaggaaaactgtttactactttggttttagcagctcagttttactattccataatgtgttatttttaaagttctctttttaagatcacagtgatatcctatcttcaaattttttaaatatgtt

SEQ ID NO: 1397 - DNA, 300 bp, Homo sapiens
aattccgttgctgtcgaaaaaagttaaataatcaaaaatcattcagaagagagtaccttaaaagacccatatacctctgagaatttagaatgttacaaaaccgtatttcataccaatggggaaaggataaactcttcagtgacgaatattagaaaaagttagttatacatttgaggaaaactataaaagtaccaataatgagtaggaaatcacttctgcagtatttttggagcattttccttaagcatgacataaaagccaaaggtcacaagggaaaaaactgatagatttgtctgtgat

SEQ ID NO: 1398 - DNA, 300 bp, Homo sapiens
aattccgttgctgtcggtcatgtggtttattaaatgtcttcagattccagagataagacaaggtggccacttcacaaagaatccagaatcatgctcagtaaagctcattaaaagccactgcagctgagaaggttcacagcccttctttatagccacagaggcagcacacaggggaggtgggaagacacagggaaacgagagaagaaggataatgaggccttgaggtgttctgcccccaatttcaaggagcttatcaggcttcatgtgcaatttggggaggggagctttttgatggtgggt

SEQ ID NO: 1399 - DNA, 300 bp, Homo sapiens
aattccgttgctgtcgtggaggcttactaaccaggtaagccttctatgcatccacaccaaaatcctgcagaatgtaagtaagctctgctttataagatgggttcaccttcatcgcagactgaaagtttcagtttttatttttttcagaaagcacgaaaaattatttataatagtctggagaaaaaacacactgtaatatttcaagtgtatgcagtagaatgtactgtaactgagccctttcccacatgtctaggctccaatgtctcctgtaggtccacctaactgtgtgttttcagggac

SEQ ID NO: 1400 - DNA, 257 bp, Homo sapiens
  misc_feature (1)...(257): n = A,T,C or G
aattccgttgctgtcgaactttctttgcctccctccccacagaagcaccagacccacctgagccccagagcctcatgccagcagctcctggctgttnctcacctgaggctagagcagcagctgncancttatagatggggcgtatgntanttaatnctntnnnannntcctctnataangtnngnttnnnnngngntntctttnnaatacgatntgcncnnnctatnntnannanntnttatncnantnnatctnna

SEQ ID NO: 1401 - DNA, 266 bp, Homo sapiens
  misc_feature (1)...(266): n = A,T,C or G
aattccgttgctgtcgcactgaagttttgttttagacactttgggcttcgctgattgaaaacaccacaccaactgaaaaatcactgtgaaaaagaacctggtagtactgtcaatatcaagtaggattcattaattttctgacattactggacaagatggttcgtgccattcagaaagctctttttctttcttcttctttcctaatacagtgaggcatacaacgtagcctgccttatggttaannngcntgnngactttatnnttnc

SEQ ID NO: 1402 - DNA, 300 bp, Homo sapiens
aattccgttgctgtcggctgcggccggtttggcccttctttgtaggagagtttcatccgccctgaaatcttcccgatcgttaataactcctcaggtccctgcctgcacagggttttttcttagtttgttgcctaagagtacaccaaatgtgacatcctttcaccaatatagattacttcataccacattgtcaaggaaaggactagaagaattttttgatgacccaaaaaactgggggcaagaaaaagtaaaatctggagcagcatggacctgtcagcaactaaggaacaaaagtaatga

SEQ ID NO: 1403 - DNA, 300 bp, Homo sapiens
aattccgttgctgtcggccgccgcctctccaagttcttgtggcccccgcggtgcggagtatggggcgctgatggccatggagggctactggcgcttcctggcgctgctggggtcggcactgctcgtcggcttcctgtcggtgatcttcgccctcgtctgggtcctccactaccgagaggggcttggctgggatgggagcgcactagagtttaactggcacccagtgctcatggtcaccggcttcgtcttcatccagggcatcgccatcatcgtctacagactgccgtggacctggaaatg

SEQ ID NO: 1404 - DNA, 209 bp, Homo sapiens
  misc_feature (1)...(209): n = A,T,C or G
aattccgttgctgtcggcctaagatttcttgtgggccaaggaattaattattccaatcagaaatggaggccttacctcatttgggcaaagattagtgctagttattgaagatttactaataaatgatctgttaaggaatttagttttttttggatatgttgttttggttgnngaaaactanggnatanttataatagntattttttgaa

SEQ ID NO: 1405 - DNA, 300 bp, Homo sapiens
aattccgttgctgtcggaatgatcaacttgttaactattgctgagatgctgtgtaagaagactgaacatttgccatttggtgatgtggaagctgttgagcttcactaaatggtttccacggagtggaggggaaaaggcttgtttgagtggcctcaaatgaaattgggaagagagggaagagacagtgtgagtataaatggttccttttggaaattcagtacaggagagcaaagaattatagatcgaggggtataaggagggtcaataaattttaagagaggatccattattcatcagttc

SEQ ID NO: 1406 - DNA, 300 bp, Homo sapiens
aattccgttgctgtcggtttggtttatatataatgagggaagaagatgattacattatttttgtcactttgccatcattgtttagaagtcatagaaagaatttttaaataggccaataagtcttaaacttgagtacttggcttagaagaaagtcaaaactccttcctttttgactaagtggtttgtttctggggagctcttaatttctatttttataatcattagcctataaggaaattgtgtcttccttgttctcagggtgatctgctgaccttgttcactcatgaagcatttgggtat

SEQ ID NO: 1407 - DNA, 300 bp, Homo sapiens
aattccgttgctgtcgcttcagttaagtaaagaagcagccccataagcatttttgtttgtccgtaattggccctattgcagaaagaaagaaagaaagttgccctcaaatgcgtgagacagcatggcaggctagggtgtaacagatgagttctgagcagggaaggtgaatgaagcaagtggatccttggaaagataaggtaaagaaaggatgttagttggaaactagcaatcaggaaggtcagctgctgcctggtctaggtagagtggcagggcagaggagggcttggctggatatggtaa

SEQ ID NO: 1408 - DNA, 293 bp, Homo sapiens
  misc_feature (1)...(293): n = A,T,C or G
aattccgttgctgtcgatgtgtctctggtacagaatagttgatattaacagaaaaaaaaaaatctgtagcttcatgaatatgccactctgttaatttcttgttccagacattttaatagagattgcttgagccatgttgtttgaattgctgccaatagcagaccatatccctatcatgttgttggctcaactgtttttttttttccntaatanaaanggagtatcnntgggtngntnaggctggcnttnaactccngggctnaagctatcctccngcctnggcctcccaaagt

SEQ ID NO: 1409 - DNA, 300 bp, Homo sapiens
aattccgttgctgtcgaaatcatcccaaacaacgcattattaccatatacatcaggatattaggagcccaatatagtgatccagattgagatcctcttctttttgtatgtgtctggattttgtttgctagggttttcaggatttttgtgtatatatgcatgagatactcatctgtagttttcttgtgatgtctttgtttggttttggtatcagggtaatactcgcctcaaagaatgagttgggaaatgtttccttctcttctgttttttggaagagtttgtgaagaattgatcattcttt

SEQ ID NO: 1410 - DNA, 300 bp, Homo sapiens
aattccgttgctgtcgctctccgcagtgagaacctgccttggctcccctcccctcaaggagttcatagccgtgggagggagggagacaagaactgttggagacaagaactgttagagaccagagagcaagggcgtgatgtggtctgcagggaggaggctgtctgaggcagaaccgggtcagggaggccatggtgcgggtaccctccaggcacggcatttggcctgacttttgaggggtgcccagggttggctacatggcggggcggaggtatctttagtgggggaacagcgttgtgccac

SEQ ID NO: 1411 - DNA, 300 bp, Homo sapiens
aattccgttgctgtcgtaaaaataaaataaaaaataaatgtgggcaaaaatgtgcagtgtgcagattcagcatcagatacgtctggagtgcctcgggcatattcattgctactgttgatttcgtgctcctgtttctgccctaaatgtgtgccacactgacgaccacagtgtagcccctagtcccgtctccatctaatctctccctcatcctaaaggctcagtctccagaacaaatcctacattgtctacctgtcacctctgtcctagcccaggacaccccccactccctggacacctgct

SEQ ID NO: 1412 - DNA, 300 bp, Homo sapiens
aattccgttgctgtcgaacaatttttagagaagaagaaagagaataaaagactgaaaaggaaacagaaggctcttgctgaagaggccagtgaagaggaacttccctctgatgttgatttgaatgacccatactttgctgaagaagttaaacaaataggtataaataaaaaatcggtaaaatctgcaaaagatggcacatctccagaagaagaaattgaaatagaaagacaaaaggctgaaatggctttgcttatgatggatgaggacgaggacagtaagaaacacttcaattacaacaag

SEQ ID NO: 1413 - DNA, 300 bp, Homo sapiens
aattccgttgctgtcggaaacatgaaaaagaaaatgaagaattcacagggcaactaaaagtggctaaagatgttgaaaaactcattggacaagtggaaatctgggaggcagaagccaaatctgttttggatcaagatgatgtggacacctcaatggaagaatctttgaagcatcttattgccaaaggctctatgtttgatgagcttatggcaagaagtgaagatatgttacaaatggatatacaaaatatttcaagccaggagtcctttcaacatgttctcacaactgggcttcaggcaa

SEQ ID NO: 1414 - DNA, 300 bp, Homo sapiens
aattccgttgctgtcggtagactgagatcagtgtgtaggggtgaagcaaggagtcctactctgtttgactaaggtaaaaattaagaatcagtgagaaatggaatttgcaaaagtgcctgccagataatgttagaactggaccagaaaataggagttggtataaaactagaccagcgagctttttttccttcaagatgcagttcagtttattgcttttgtaaattagagattgtgtttcttgatctttattaaagtagaatacaatgttaacctacttcaaattttaaaaaatatacacac

SEQ ID NO: 1415 - DNA, 300 bp, Homo sapiens
aattccgttgctgtcggttttgtacgcaccgttttctctctgtgctatgggagatgtcaaggaatcaaagatgcaaataacaccagaaactccaggaaggatccctgttttaaatccttttgaaagtcctagtgattattctaatctccatgaacaaactctcgccagtccttctgtttttaaatcaacaaaattaccaaatagataaagatgtggaagacaaaagacaaaaagccattgaagagtttttcactaaagatgtcatcgtaccctctccttggactgatcatgaagggaaac

SEQ ID NO: 1416 - DNA, 300 bp, Homo sapiens
aattccgttgctgtcatgctgaggttgttaaacaggccccatgtagctgtccccacattggggtttgctttctacttcccaggtgtttctcagcgtgagagtttagtttgctttgtgctgctggacaggttcctgcagaatggcctgttgtacgagttttaagaatttaaatcccattacacagccctgacttcttatttgctagttctttccatcattcatttattttatccacttggagttagtctgtggctgccatgtgtttgtcaggtggcagaggatgagagatggatgaaaagg

SEQ ID NO: 1417 - DNA, 289 bp, Homo sapiens
  misc_feature (1)...(289): n = A,T,C or G
aattccgttgctgtcggcaagctcgggggtcaaaccgaaacatgcaattcactaaaatctttcaggaaaaaatgactttaaatactgtcatcataatcccactttgtacctccttctcttttcatatccatgctcaagtggaagttaacaaatccctgcccccagagagctgcccaaagcatcacgttttagaaactgtcccagaatttccaaactcatccaaaagcaagtgacatcaagtcagatattcttggtgctagaaactcagaaaaaaaaaaaanggggggtc

SEQ ID NO: 1418 - DNA, 300 bp, Homo sapiens
aattccgttgctgtcgaaaacatattagaactaacaaacttacaatggacatttaatagtggttttcctttctattctattttttaaaatgtaaatggagtaaatgataaaatgtagactgaatttatcataaagacattttcttttggtatactgcaaggaactatgaacttttagtaactactataagcaactgacaggaaaaaatggcaacagaagaaggaaagaggagagaatggggagcagacactaaggtgtagtgaaaggaggaaaatgaaggctaagtctaatgatgtgaat

SEQ ID NO: 1419 - DNA, 300 bp, Homo sapiens
aattccgttgctgtcggctgaaaatgaaagcagacctagaagaagtccaaagtgccctttacaacaaagagatggaatgccttagaatgactgatgaagtcgaacgaacccaaactttggagtctaaagcattccaggaaaaagaacaactgagatcaaagctggaagaaatgtatgaagaaagagagagaacatcccaggagatggaaatgttaaggaagcaggtggagtgtcttgctgaggaaaatggaaagttggtaggtcacccaaaattttgcatcagaagattcagtcctagtg

SEQ ID NO: 1420 - DNA, 263 bp, Homo sapiens
  misc_feature (1)...(263): n = A,T,C or G
aattccgttgctgtcgaaagccgattcatgtactgatgccaatcagctagagcaatgtaggctttttttaatttaaattattactacactttattactacacttgcagaaaagaaacatgttaaaatcatggcacacctgcagaatttnatatgacagagtgnncanatcatgtattcntgnntntanaatancnttnttncnctacntcttntntttcctnanannatatctantanttnttnagtctntnnttcnanaaat

SEQ ID NO: 1421 - DNA, 300 bp, Homo sapiens
aattccgttgctgtcgcagccacaaagctcctgcccatggggcgctctgaggggcagactgcctgttggcggagtcttgtggggtggaaatggtgaggtcactgtgatgccactttgcttagtcatcggccacagggtcacctggagaagagcatgagctcagcataaaagcaaggcccaccctgcaggggccagcagctgggagctgtccactaaccactatccttgcagctggacagcgaggcccctccaaaaggccgtctccacctgccaccgggaaaggacccggagcgaaggatg

SEQ ID NO: 1422 - DNA, 300 bp, Homo sapiens
aattccgttgctgtcgattatagccttctataaaacttataaaacttgcttgtaaaattccatatagagattgcaactgagagttggtcgtaaaactaaaaatattgttgggaacagagcaggtcaaaactcccatgattgatctaataatggaattatactggtaaaaagccactgcacttcagcctgggcaacatggcaagactctgtctctaaaaagagacaaaacagcataaaaatatgcttgatataaactctagccctcttctagttatttgttcatttgtacattttcatttc

SEQ ID NO: 1423 - DNA, 274 bp, Homo sapiens
aattccgttgctgtcgagactttgatggttatgaatggaaccaagttactgagttagagcattttctaattaaatatgaaataggagctgaaggcataatttattgattagaatgacagaaaatgtttttatgctgtacatgccttttgaacatttttcaaaatacttgtaactttgaagaaagtgtgtatattgttagaaggctgtaaggagagcaggtctctgctctggtggtgattttactcaagaggggatgtgaatatttatatttttg

SEQ ID NO: 1424 - DNA, 300 bp, Homo sapiens
aattccgttgctgtcggagaaacccaacacatgtaaggaagattagaatgtatgcaattttcctagttcccttctaaaacttagaaggacccgtcctgggaaagaacgtcataaaatacgaaaaatgtgttagaacactttattttcccagccgctttcaaatatatttttatcagtggttcattgttaaagaaggtgtctatactttagattttcagttttttgcagggaatcatggagctgagaatttcacagatactttataagccatagtacatgagcttaataggctgtgttttg

SEQ ID NO: 1425 - DNA, 300 bp, Homo sapiens
aattccgttgctgtcgattatatgccacctgggtttacagtgtagtctcttatcaggtaggtttgttctgagatgtatagtaatgatgactttcttcttcgcccaagtattttgtgtaccttagaccagtttagcaaatgaagtccaagaactatttgaataagtcattcttagaaaataactttaggaagcaactgactccattcatgtgtatgcctctaattgtaggttcacttctgtccgaatatgaatttttaaaataattttagcattatattagcaatttgcaatataccattt

SEQ ID NO: 1426 - DNA, 300 bp, Homo sapiens
aattccgttgctgtcgcaaaaggggaaaaaagtccaggtcagcataagtcattttgtgtatttcactgaagttataaggtttttataaatgttctttgaaggggaaaaggcacaagccaatttttcctatgatcaaaaaattctttctttcctctgagtgagagttatctatatctgaggctaaagtttaccttgctttaataaataatttgccacatcattgcagaagaggtatcctcatgctggggttaatagaatatgtcagtttatcacttgtcgcttatttagctttaaaataaa

SEQ ID NO: 1427 - DNA, 300 bp, Homo sapiens
aattccgttgctgtcgctgtcagcgttttagctgatgaagaattccttcccttcaaagaaaatacatttgacctggtggttagcagtttaagtttgcattgggtgaatgaccttcctagagcacttgagcagattcattatattttaaaaccagatggagtgtttatcggtgcaatgtttggaggcgacacactctatgaacttcggtgttccttacagttagcggaaacggaaagggaaggaggattttctccacacatttctcctttcactgctgtcaatgacctgggacatctgctt

SEQ ID NO: 1428 - DNA, 300 bp, Homo sapiens
aattccgttgctgtcgctcaactgaccgttggatttgcaatgtggacctgaagagtaattgtggtgaagttgtgagaatgaaactgaagtgggttcaagaaagaacgagaggagagaaagtggagtttgagtataaataactcttttggagaggattggtgtaattgaatggcaggggtatgagatttgaggtcaaggaaatatttttattattttttacgatgagagaaattgtagtacacatgtatatttatgggaatgactcagtagaaagaccaaaaatttcatatgtgagagaag

SEQ ID NO: 1429 - DNA, 300 bp, Homo sapiens
aattccgttgctgtcggcagaggggagaaggtgtcccaggaggagccttcctggaggggatgatagtccagcatgttctgaagtgggagtagggtgcggcaggagtagggtaccagagaatgagtgagtcaggcagcagcctccactgcgccttggacacaggtggctgacagtgtccacctggactggctttgcaccccttctgaggtcacagttgtgtcccttgaaaacttgggcaggagcacctgactggcccagcttgggtcatccctaggcccagcagtgcgggaggccaggaaa

SEQ ID NO: 1430 - DNA, 270 bp, Homo sapiens
  misc_feature (1)...(270): n = A,T,C or G
aattccgttgctgtcgcactgatttactccctctcttccccactccctgtgaggctgggctgaggcacggatccctgggccacagagcaagtctccaaatcagacagctgcctcagcccctgggatgtgtgatttcagctcctgtcacctcatgcaagggcgtggagaccagtagaggtgtggaggccaggcagagagaggagcctgctctgaggggtgcccannntnatggncactgtccnttcanntagcctgnctangncccctgag

SEQ ID NO: 1431 - DNA, 300 bp, Homo sapiens
aattccgttgctgtcggtaatgtttcacttcttgaaccatgtaccaaatttgccaattttctgtccaagtgtttcagatgaataacaaaacgctgttcattgaagctttcgccacctttcttaaagcagcgtatgttccaagggaaaaaggcattgaaaagcaatcgtttgtttttatgaagaataggtgttcagattccttcagtttttttgaaattagaaatttcttaccttatgtgaaatattcacaaacgtgcacacttctgcagagacaaagcatttcactgcacgtgtaccagg

SEQ ID NO: 1432 - DNA, 300 bp, Homo sapiens
  misc_feature (1)...(300): n = A,T,C or G
aattccgttgctgtcgaaggaattctgtggctgtgctgcgtttcagaaaataacccccagaggccttgggctgtggacctgggggttggaaggatgggggctcatttaaccctcagaggcagcgcctttgtctgtctatctggtgacaagagagagacaagtaaatgggggccgttgggacggcgggtgcctggagggcagctctgggctcatcgggcagtgcttagagcacaggcccctctgttgggggatggggaggagagcagtctgcccttgggancgtatgccccanggagactt

SEQ ID NO: 1433 - DNA, 300 bp, Homo sapiens
aattccgttgctgtcgggctgactcctgcttttttggagggtttaacttctctctcagctagaaggttaggcattgcaaataccagtggataatttttttcttagctttaaccccagcccatttcaaccccctctttgccctttgtatattcttttgaaaatatgatccagtagtgtttatgaatgtgtgttgtgtaaaatttagagattgatgttaaacaacagaattaaaggacaaagctgtcttttttgttggaattggggatgggagagcagctcaaagtgggaaatatggagaaa

SEQ ID NO: 1434 - DNA, 299 bp, Homo sapiens
  misc_feature (1)...(299): n = A,T,C or G
aattccgttgctgtcgctttttacaaagaaaaatggaaaaactttgtatggtagcttcatgttgaagtggttttttgtttttgtttttgtttttttaatttgtaaaatctggaaagttagcttgttctaataggggctatgctctgcaattcccttttttttttttttttncntnccncnaagcnaaaccntnannaaannntngnggnntnnaanggngggccgnnttttccnccngtnggnatnnnanntaaggggncnnngnaaaaccaaancncntngaaaancnnnggagggcc

SEQ ID NO: 1435 - DNA, 300 bp, Homo sapiens
aattccgttgctgtcgggtactgtgaatggagagcttcagctaagaggaggctctgtcccttttcagagccaaaggaaataatacaacaaaaaggaggcttctttggagacctaagtctattggatgtaaacaagacgttgtatttagggatgttctgtgtttctttcttttttgaagttgtcatcaattgctttactaagatttttaaatagtgaaaacctcctgtttagactttggtggaagatgaatcaaggaagcagggccctgtcttatgggtcacgtgtctttggtgagtgaga

SEQ ID NO: 1436 - DNA, 300 bp, Homo sapiens
aattccgttgctgtcgattttatatgttttctcctatatttcttgttttcatccaggactactagattccagtaagaataaaattaaacattagaggtttgtcttccatgttgtttaagaaaattagtttccctttttaaataattactaatatttgaagattatgaatcataaattaatcacaagtgccatacctattattttagaagcaattgagcaatataaatggtcttcagttttaccagttcttgatctgtagtaaattccaggggtggtggggtctgtgaaataatgaagaaa

SEQ ID NO: 1437 - DNA, 300 bp, Homo sapiens
aattccgttgctgtcggtcaaatttcatcaggtaagaagtgctaaagtgaacctgtaaactttgtttcaaaaaacaaaaaccgaagtttaagaaatctaaagatggtgtcagccttagacagatctctggactgtaatctgggaaaggtcaaataagatctccaatcgtgtacaattccaaatacatttgagagcagtgggtctgaaaatgtggttcccagaccagcagcatcaacaccatgaaggaagttgttaaaaatgcaaattctcaggctctcccctgtgctttaataaagtttc

SEQ ID NO: 1438 - DNA, 300 bp, Homo sapiens
aattccgttgctgtcgcaaaaaggtacagtgattcagccatttccatttgtcatttgtttcaaccttttttaagttgagtgtttttatttctgcagttattagttggatcctccacatcttgcatatatacatgggctcaattattatgtttgtcaggataatcaaatgaaaatactagttcagtgatcagcattgaatggttgttaggcagccatgtgctcaacactgatttcacctcttgagtataaactttttaaatttaaattggtttacatgaaagtggattaaaaggcctttca

SEQ ID NO: 1439 - DNA, 300 bp, Homo sapiens
  misc_feature (1)...(300): n = A,T,C or G
aattccgttgctgtcggagagtggaggccagagaagaccaaagctgaggaatgcgacctcaggatttccttctttctggggatagttctctttaggaggaagaggagttagcccctcacttgcttatccctctcctatgctctggagttcctctccacccttgcccccaccccacattgccccctcctgctcggtcagtgcctggccagctcaggcagcttgcgtcacagtaaggtaaagccagaatgagnattangnctgagcganantgnaaaagccattcctntgaccctacccacc

SEQ ID NO: 1440 - DNA, 300 bp, Homo sapiens
aattccgttgctgtcgcttttttggcaaggaggacaaatacgcaatgttggaaaaccttggatggatatcttctctttaaaaaaatgtaaagataatttggtcttgagggtttaaacggttgataatgcctctacaacaacaagaaaaaagataaaatactaggatagaatcatggtgggcacagtggcttctcaggaggctgaggagggaggtttgcttgagtccaggagttggagaccagcccaggcaacatagcgtaaaccctatctctaaaacaatttttagccaggtgcggtggc

SEQ ID NO: 1441 - DNA, 300 bp, Homo sapiens
aattccgttgctgtcgtcagatttctgatttgaaaagaatgatttcaaaacttgaagctcaggtcaagcaagtagaacatgaaaatatgttaagccttcgtcataattctagaattcacgtgagaccctcgcgtgccaacacactagcaacttcagacgtcagcaggcggaaatggctgattccaggtgcagagtattccatctttactggccagcctctggacacccaggacagtaacgtggataaccagctggaggaaacctgtagcctagggcaccgttcacctctggaaaaggatt

SEQ ID NO: 1442 - DNA, 300 bp, Homo sapiens
aattccgttgctgtcgaccccaaccctctctcatgttcagtctgtctaatacatgccagagatttttttttcaaaaagtgctttatccctacaatgtactgacagttcttacagttgagatttgttcttttcagctattgcttgtgaaaaaaagcaagactatgtcactctatagaaggctgttaaagtgactcaggcaggaattaattattctgtacctaaggggttacttgtttaatgggatggcattgactttttgaaaatcaagtggactgagtcattgataaaacatttctaaga

SEQ ID NO: 1443 - DNA, 300 bp, Homo sapiens
aattccgttgctgtcgcactgaatgacttaaggctcgacaaatgatattcttggaaagtttaatcttgaggttttcaaatctttttttttaatgtctcccatgtttctcatttgctgattgattcattagttgctcttagtaagatttgtcagttggaaataatgaaggctgagactcatttctaaactcttccataaccatcaccagaagagcagccactgtgttgtgtgatgtaggctaatgcctcccagatagaggtaaagtcacaaggactattagaattccagtggattgtggaa

SEQ ID NO: 1444 - DNA, 245 bp, Homo sapiens
  misc_feature (1)...(245): n = A,T,C or G
aattccgttgctgtcgggaagacagcccagaagcttgctattcagaaggctttgtcagatgcattccagaaactgttgattgttgttctagaaagtggtaaaatagctgtggagtacagacccagtgaagacatcgtaggtgtcagatgcgaagaagaactacacggtttaattcaagtcccttgctctccctggaagcagtatggccaagaggaggaagggtatctctcggatttcancttgna

SEQ ID NO: 1445 - DNA, 300 bp, Homo sapiens
aattccgttgctgtcgataccacctccttgcttggtatcttttacaaaatgttatactttatggatataaaggtgataaagattggaaataaatcttctaaatatgtaaaatgaaagcaacagcaacagcaaacacaattatcgtattctttgggagtaacaaatactggttttcattttaaaactaaggaaaattttatcagtacttaaattcaatccaaaaaaggttttataacacccaaactgtacatttaaaattatgctttcttaaggtaatggctagcattacctagtttgtag

SEQ ID NO: 1446 - DNA, 300 bp, Homo sapiens
aattccgttgctgtcgatattgttcaataatgtcctttcatttgtttctgattggtttcatcctgatactgtagttcactgtagaaatgtggctgctgaaactcatttgattgtcatttttatctatcctatgttaaatggtttgtttttacaaaataataccttattttaattgaaacgtttatgcttttgccaacacatcttgtaacttaatatactagatgttaaggttgttaatgtacaaaaaaaaaacccttatactcacctgcgtttccatttgtttgacatttgtctattatt

SEQ ID NO: 1447 - DNA, 300 bp, Homo sapiens
aattccgttgctgtcgggctgacgtgaaatgtaaactagtaggcgtgttattgatctgctaaaactaaccctctttttaagaggagatttaaggaagacgtcaatcaaaatgtcaaatatgtgtgtcagaatataaataatttttcacattgtattgttgctatataaaaaaaataatagaattggttgggtttctgaggtgaaatccagagtaagagtactagacagttcaacaagccacatctaatggcacagatagaggatgtagctattttatacctttcataacatttgagagta

SEQ ID NO: 1448 - DNA, 300 bp, Homo sapiens
aattccgttgctgtcgactattaactaggcttcagtatatcagtgtttatttcattgtgttaaatgtatacttgtaaataaaatagctgcaaacctagttaatagtagtgtaacaatatgcatcattttgatgattacattattttaaacaacaaactacactgaaaaattaatgccgataaaattctgggggtgggaaggtaggatgtggagtgacatggttctatcctttacttatgagactcagaaatatatctacaaagccagatgctctgtcttcatatttgcagacatctagac

SEQ ID NO: 1449 - DNA, 300 bp, Homo sapiens
  misc_feature (1)...(300): n = A,T,C or G
aattccgttgctgtcgatttttctatgtatgtgatgtgaaatgaagactatatatatggaatggaggtgacagaaagaaagaaattctttgtttgagggagacttcccctttctggattgtatttgtagagtgttacgagtgtatcatgtgattatgctttaccggtataagagattctgttgngattatttgaatagttntatattaatanaagaagacaaaantttttaaatgttanaaaaagcngatctgtcattgctnngtatcntaaantttangcttttatcnatgtatatttt

SEQ ID NO: 1450 - DNA, 300 bp, Homo sapiens
aattccgttgctgtcggctgttcaacattacttaatgacttgaaaatattttttattagttgtagaaaactcaacaattttcaaatattgctttggctacattcaccttcattcctctgggattccacttaacatttattaggtctttttgcttaattccctatgtctcttctatactttcctgtattttctactcttgtgtctcccttcactccaagaatttacttcttttttgtttgtttgtttgtttttgagacagggtcttgctctgtcgcccaggctggagtgcagtggcatgat

SEQ ID NO: 1451 - DNA, 300 bp, Homo sapiens
aattccgttgctgtcggaaacctcaacagacactgccgtaacgaatgaatgggagaagaggctttccacctcccccgtgcgactggccgccaggcaggaggatgcccccatgatcgaaccacttgtccctgaagagaaaatggaaaccaagacggagtccagtggaatagagacggaacccaccgtgcaccacctgccgcttagcactgagaaggtggtgcaggagaccgtgttggtggaggagcggcgtgtggtgcacgcgagtggggatgcttcttactcggcgggagacagcgggga

SEQ ID NO: 1452 - DNA, 300 bp, Homo sapiens
aattccgttgctgtcggtcccacccccacctcgccggagtccggggcggccccggtgtcccctccgagcctgctgcactccacgtccccctaccagggctccagcccccagggaaatctccgaccaggcccgcccaggagccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatctgca

SEQ ID NO: 1453 - DNA, 300 bp, Homo sapiens
  misc_feature (1)...(300): n = A,T,C or G
aattccgttgctgtcgaaatcatgtacagaattgcaagagacccacggagaattatctaccaacaatatgcatcatagaaatttagaaaacagaagaaaagtcactacagtcctaccactcttactgttacggtattagaaatatatatagtggatagccataagtataaatgatcncatatagcatgtnttttataaaaattggtttatactgtacattctatcttgtgangngatgnntttcacntgccactgtatcatgcccatttccctctntctgctgtctgtattcttcttgat

SEQ ID NO: 1454 - DNA, 300 bp, Homo sapiens
aattccgttgctgtcgggaaaactacaggtgttgtccaagctcttagcggttatccacgaacttcgacctactgaaaaggtggtgttggtatccgactatacacaaaccttgaacattttacaagaagtatgtaagcgtcatggatatgcttatacaagacttgatggacaaacaccaatctctcaaaggcagcagattgttgatggctttaacagtcaacactcttctttttttatttttttgttaagttcaaaagctggtggtgtaggacttaacctcattggaggatctcacttaat

SEQ ID NO: 1455 - DNA, 300 bp, Homo sapiens
aattccgttgctgtcggcaaaatagtattttctattactgtgcaggggaaagggatggatcgatacatgcaaatttaatgtagtaactcacttttccatatattttgaatgtatatttctatttatgataccaatttataaaaaataattacacagaaaaaatggaataggaaaaattatgcatctagcacatttaaactgtgcaaatatgaaaatttttcgaggattacattttatctgaaggctgcatattttaactggctttaaaactgtaacacatcacataaaagatactttacc

SEQ ID NO: 1456 - DNA, 300 bp, Homo sapiens
aattccgttgctgtcgaagaaaattttctatgattataatattccaagtaagtttctcttttgagatcatttgtctattgtaggaagtcaggtaaataagtttagttttaaaaaacaaaaatttctcaaatcaggattctttctgaccctttaatctcagataatgataatagagtattatttcaaggattccccttctagcacaatcttgctcaagatcaggccaagaatatagacaggttcagtaaaccacaagtgctctaaacctgcttgaacctatgtaagaactgagcagtgggg

SEQ ID NO: 1457 - DNA, 297 bp, Homo sapiens
  misc_feature (1)...(297): n = A,T,C or G
aattccgttgctgtcggtagagacgggtttctccatgttggccaagctggtcttgaactcctgacctcaagtgacccacctgcctcagcctcccaaaatgctgggcttacaggtgtgagctactgcgccaggcctaatatcttttttttttttnnaaanaaagnntngtttngggcccagnnngaagtgnagggggnaaatttnggntaatngaaccntcngcntccnnggttaaaaaaattttcnngcntaaccntcnnganaannnggaannacgggntngcccnacaaccccaa

SEQ ID NO: 1458 - DNA, 300 bp, Homo sapiens
  misc_feature (1)...(300): n = A,T,C or G
aattccgttgctgtcggattttttttttctccagaggcttagcgtaggtcataccccagatgttgatgatgaatatattgattgctatctcagggcgaaatctcaaaagtttgtgttgcccttttaggaatttcacagtttatattgacctataaccaagaggcaggttcattatgtttaattgcattaaaagataaaagaagtagacaaattgaaaggaaaaagagcccagagattggtacctttttatcaagcnacancatgccacaaactttgcatacataaaaaataataacctga

SEQ ID NO: 1459 - DNA, 300 bp, Homo sapiens
aattccgttgctgtcgctctacttttaaccagtctcataaaatgcctggggttcataggtgaagctggattgttgcaggaattctgcaattgttggcaaagcgaagggcagtttgactccttaattataaagttggatgtcatttgagaaactctgggaattggaagtagaacaaattcatactttccctataacttttaatttcttgtcatacattcagaaaacaagagatgtaaaattcataaaactgcttgtataaattcagaaaacgggattataaaagcaaagacaaattgtctt

SEQ ID NO: 1460 - DNA, 300 bp, Homo sapiens
aattccgttgctgtcgatataacccaggaacgtgacagtcttatgtgtttggcaaaatgtttagaaagtgagaaggatggagtgcttaataaagtcataaaaagcaacattcgcctgggaaagttagaggaaaaagtcaagggctacaagaagcaggcagcactgaagctgggggacatcagtcaccgtctgctggagcagcaggaggacttcgccggcaagacagcccagtaccggcaggagatgcggcacctgcaccaggtgctgaaggacaagcaggaggtgctggaccaggcgctg

SEQ ID NO: 1461 - DNA, 300 bp, Homo sapiens
aattccgttgctgtcgcttgcaccgtgtggacagactctccggttctggggaaatccagtccctgttactccattttggccagaaattcaaggatactgtcatgaagcagacacatgctgacacacctgttgatcattgtctatctggcataagaaagtgtagcagcacctttaagcttaaaagtgaagtcaacaagcatgaaacagcccttgaaatgcagaatccaaatttgaacaataaagaatgttgtttcacctttacgttgaatggaaactccagaaaattagaccgtagtgtgt

SEQ ID NO: 1462 - DNA, 300 bp, Homo sapiens
aattccgttgctgtcgctggcttcctcagcattgccgagatgtacagctctgtggcagaccagtggtgcctgattgtccccatgcacacgcgcaggagccgggtctccctggtggccagctgtgggcgcctctacgctgttgggggctacgacggacagtcaaacctaagctcagtggagatgtatgacccagagacagactgctggacattcatggcccccatggcgtgccatgagggaggggtcggtgtgggctgcatccctctcctcaccatctaaggcagaggatgggatgtggtg

SEQ ID NO: 1463 - DNA, 300 bp, Homo sapiens
aattccgttgctgtcggagatgtactgtgcttatggatatgaagactcaataacatgtcaattctccacaagttaataaatgtataaatttacttcaattgaggattttttattagacatagacatgctgattttaaaattcaaatggaggccaggtatagtggcttacgcctgtaatcccagcactttgggaggccacggcgggaggactacttgagcccaggagtttgagactatcctgggcagcatggtgagacctcatctctactaaaaatacaaaaattagccaggcatggtggt

SEQ ID NO: 1464 - DNA, 300 bp, Homo sapiens
aattccgttgctgtcgctctgtttctctggctaatgtatttttatcacacccaagaaatttaacgtttataagatgtaatcatttaatataccaaccatgtgtatactgcttcagttgctcctcagattcctgaatctaatcagatataacactttgcattttgtttaccggtctctctagtcttctgtaattttcccagttttttcccataatactgatttttttttcagcattaaagctagctctcttgtagagtagtccacagtctgaatttatctgattgtttcatgattagattc

SEQ ID NO: 1465 - DNA, 300 bp, Homo sapiens
aattccgttgctgtcgaaaggttacattctttttggttcatctactcagaagctatttaatgaatgttcactccatgtcaggcatgtggcatgttttcatctctaccagtaacgctgaactttcttcttgtgtgcatcagcctgttgttttcttttgtaaatgttctgttcgtgtccattatcaacttttctactagggtgtgactgtttctatgatatatttataacgatgtgtgtgtgtgtgtgtgtgtatacgatatttggggtaaatacttttcccagcttctttgacttttaatt

SEQ ID NO: 1466 - DNA, 300 bp, Homo sapiens
aattccgttgctgtcggcggcaaattgtggaacagatggaaaagaaccaggaggagcgatcgctgcttgctgagcagcgggagcaggagaaggagcagatgctggaatatatggaacagctccaagaggaagatctaaaggacatggaacgaaggcagcaacaaaaactgaagatgcaagctgagattaagcgcatcaatgatgaaaaccagaaacagaaagcagaactcctggctcaggagaagctggcagaccagatggtgatggagtttaccaagaagaagatggctcgagaagcag

SEQ ID NO: 1467 - DNA, 300 bp, Homo sapiens
aattccgttgctgtcgcaatttctgagtctctttctatttaatgccaccaatttctgaggaactagagtgcagagtggattgcttttcagctttttctattaggattcagatagctttttaattgctgctaatatatttgtcattcatattgcttttttgttttcaaaattcagttaatattttttcttctcattcattttgactttgtaggttcatgccatttgtaaaaccctctttgttgtctttttattggaattttgagagggagttaaatgtctgtttttaatctaccatcttta

SEQ ID NO: 1468 - DNA, 300 bp, Homo sapiens
aattccgttgctgtcggacagcagctccgaggtcggcgggggtctgggtggccatggaggagccccctgtgcgagaagaggatgaggaggagggagaggaggacgaggagagggacgaggttgggcccgatggggcgctgggcaagagccccttccagctgaccgccgaggacgtgtatgacatctcctacctgttgggccgcgagcttatggccctgggcagcgacccccgggtgacgcagctgcagttcaaagtcgtccgcgtcctggagatgctggaggcgctggtgaatgagggca

SEQ ID NO: 1469 - DNA, 300 bp, Homo sapiens
aattccgttgctgtcgccaaaatgtatcccagtaaagggctttggtaaaaaatataaataatttgaacaagtgtccagaggggagataatgtacagaaggaaaaaagaataatgggcttttaacttcttttttttccctcagtttttatctttttcctatatagagatgggagtctcactatactgcgcaggctggtctcgaactctcttgggctcaagtgatcctcccacctcggcctcccaaagtgctggagttacaggcttgagccactgctcctggccagcttctactttaaacct

SEQ ID NO: 1470 - DNA, 300 bp, Homo sapiens
aattccgttgctgtcgacgagcttttgctgtgttggccagactggtctcaaactcctggcctcaagtcccaaattgctgggatttaggcatgaaccactatgcctggccataccgtacagaaacactcttatggtgtatgtatgcgtctatttggaacttagttttgtagtctttttttaaaatcatactttattatagtaccttgttatcattttgaatatgttaaatcaacactataatagttaaggtagacagaacattaggacataccgtattctatattttttcctctgtatttg

SEQ ID NO: 1471 - DNA, 292 bp, Homo sapiens
aattccgttgctgtcgtaatcttaaaaatacttgcctcaaagatttattgggataactaagatctgtaatacttggagataggaactatgtcacatagtgcatgacacatgaaaggcacttaatattcattgaattgaattaaatctcacagatttaaataaaaggcctttgccttaatgttcaactttgtatttggtatgaggtctctctgtctcccttcaattaaatgatatttagaggtatgctcacaatagattagacatagttaatttttttttttttttttttttg

SEQ ID NO: 1472 - DNA, 293 bp, Homo sapiens
  misc_feature (1)...(293): n = A,T,C or G
aattccgttgctgtcggttgagtcataaaataaaaaaactagcaaatccagctctatgctcagagaattaccagaaaataaaattacatgaagcttgaatatagggagatggaaagatattagacaaatattaaagaaaatctgggccaggtgtggtggctcacacctgcaatcccagcactttgggaggcccaaggtgggaagattacttgaggcaaggggttnganancngcctgntcntnatanngaanntnngctcttnanannagantgngntnantagagtaattaa

SEQ ID NO: 1473 - DNA, 300 bp, Homo sapiens
aattccgttgctgtcgtatatgccaagaaccaaggtgttctgtcatcaaaattgattttttatgtgtgaattgacaacttgctaaagtcccccaaatttgttgtttctaaagaattggaaaccatttgagaggagctattgtaagaggggacttcagccttgatcattagccgtcaggagctctccctcaggaagatcagatttaacagtttttgagaaacttgagattctgaaatgctccacggcctgcttaccctttggaaagactgtaaggggtagaagtacccaacagaagaccac

SEQ ID NO: 1474 - DNA, 300 bp, Homo sapiens
aattccgttgctgtcggtttagcactcacatatttttgttcaatctttacttctcacacaaacagaaaaaggaaattatatattctgtatcaacaaagatttaacaaaacatccatacactacaactgtctacttactaaaattaagaattagtatattatcttttttcttcttatattaaaactatcttttcatacactattttaagtttatgaactgaaagtcttttagagataatttacttcaatgaactattattatttatattttataagcaaattgtcacaacttggtattagc

SEQ ID NO: 1475 - DNA, 300 bp, Homo sapiens
aattccgttgctgtcgcatctgtatgttgtggtgtcatagaaagagtccagacctggagccagagggagttgaattcaaacaccttgatttcttattatcagctgtgtcaagatcaaatcactcctctttggcatgctgtttttttctagaagtattactcttgccttagctattaccatcccctctcttgcttgtaggttgatatttacttgctaattcactctcagtgcattgtttttgaatcttagcctagttttttgtttgtttgtttgtttgttttgacagtctgcttactgcaa

SEQ ID NO: 1476 - DNA, 300 bp, Homo sapiens
aattccgttgctgtcgggactacaggtgcccgccaccacacccggctaatctttgtattacaggatagagttcttggaagcctggcgtggagggagggagagcaggtagcacagttacagaaggatcttcgggatatggaaatgcggtatttgtggacactcattcatctaacacacatttgttgagctcctaatgtgtatagaactgaagggatggagtcatgggcagtggaaaagctgaaattgtgtaaaagagagagaaggatcagtggctatggtctcgaagatgacgtggaagtg

SEQ ID NO: 1477 - DNA, 300 bp, Homo sapiens
aattccgttgctgtcgaagggatccagtaactgctcccagggaaaggatatcagcttgacctgcagctgacagctagtagtaactgtaagccacatgagcgaacaatctaggccatccagcccagaagaacattaagatgactgcagctccagccaacatccggctacagcaacctacgagaagccaaataagagcagcgtagctcagtcctcccagaatttgggacccagaaaataaaagggaaactaaacaggtaaacaagttgttgttttacaacactgtgtttgagagtaatgtgt

SEQ ID NO: 1478 - DNA, 288 bp, Homo sapiens
  misc_feature (1)...(288): n = A,T,C or G
aattccgttgctgtcgcgtagtgtggtttccgggctccgatgaccccagccagaaccccgcctttgttcatgcctagggtagaggcataaagttcagcacagccacaggccacaccttgttatgggcctcagaagccatctcctctccagacctgtaccacaaagctcctaatgtaacacatcattgtcctcattcaacttggctgtatgctattggagggtggaaatcacatctcctgtttatccgtgtgcttgttaggtgtcagccgncaccccccccccatatgc

SEQ ID NO: 1479 - DNA, 300 bp, Homo sapiens
aattccgttgctgtcgagaaccttgtggtcatcaataaagccctacggtctccctgtgcatggtggccctggggtccagctctgcatcactgatgtactacctatcctggcaaagatgcttcatggccacaaggcagagcccttgcatctgtgccaccggctggacaaggaaaccacaggtgtaatggtgttggcttgggacaaggacatggcacatcaagtccaagagttgtttaaaacccgtcaggtggtgaagaagtactggtatgaggcctgctgatggcagtagaggtggtataa

SEQ ID NO: 1480 - DNA, 300 bp, Homo sapiens
aattccgttgctgtcggaattccattggccagaacatagtcacatggtcatgcatatgagaagtaaaatcttggaaatgcactttttatacaggatgattatttgcccagccgaaatgtagggtttccattattatcaaagaaaaaagagcagaataggagatagctacaagtctctatctcttacagaatgtaagtcagacacatcacttgaggggcttaaaatttttaacatttcttgatgctttatgcttatcatttgtaatggaagatttgtatggtggtagccttccataaagac

SEQ ID NO: 1481 - DNA, 298 bp, Homo sapiens
  misc_feature (1)...(298): n = A,T,C or G
aattccgttgctgtcgagacttttgtatatttatcttaaattatatatctgaagtttttttttttttantggnagttnaggcttccagngccntatcagnctttatataaatcngtngaanaatcgtttnttntaaaatcaaagtaaatttntngnncatgttnaaggagngaaaaggaatttgggnatatgnaattttgctagnncttanggcttcnatctaaaaangttnatganggaccaggcncgggggctnatncctgggatcctancnctttgggaaacccaggcggccgga

SEQ ID NO: 1482 - DNA, 300 bp, Homo sapiens
aattccgttgctgtcggccgccccaggggccctgggagctgcagggcatattgctgctgagccagaatgagctgtaccgccagatcctgctgctgatgcacctgctgccgcaagacctgctgctgctaaagccctgccagtcttcctactgctactgtcaggaggtgctggaccggctcatccaatgcgggctcctggttgctgaggagaccccaggctcccggccagcctgtgacacagggcgacagcgattgagcagaaagctgctgtggaaaccgagtggggactttactgatagtg

SEQ ID NO: 1483 - DNA, 280 bp, Homo sapiens
  misc_feature (1)...(280): n = A,T,C or G
aattccgttgctgtcggtacatggtcccactttttttcttcggtctattattggactttgcatttccatatacattttagaatcaatttattccacaaaaagctaccaacaacaaaaaagcctgttgggattttattggaattgtgtcagatctatagatcaatttgggaggactgatttttagacttgctcaagtattggatactttctttttttttttttttaaaacggnntttngctttngtnncccaggnngnagggcntnggcnntntttgggct

SEQ ID NO: 1484 - DNA, 300 bp, Homo sapiens
aattccgttgctgtcgcccatcactacagtcaattttagaacattcattatccccaaaagaaccctgtacccattagcagttattatctttactttttaaatgcgggaaataaacctacatagaaagaccagaaagactttatgctcttgaactgtataaactgactccagcctacctgttgtaccttttgttgttgttgttgttgttgttgttgttataccttattttctactagttcccataatacatcatttatttaattcaggctgttttcctacttgtgctacaaagtgttatta

SEQ ID NO: 1485 - DNA, 300 bp, Homo sapiens
aattccgttgctgtcgaaattttccagttcttttttcagcttctttatttcctcctaatggaaacattatctttaaaagttgcatataggaaatatacatattttacgtttgaacaaggagatttaattgtaaatatgaaagccaaagtattcctgaatggtcaaatacagcaataaaggcagaagaattaagatttttctttgttccattgtacagtgtaaataactaagttgttaactgtcaagtccagttatgtattctgtaagttgtgttctagtctttgactaaaatttatcatc

SEQ ID NO: 1486 - DNA, 278 bp, Homo sapiens
  misc_feature (1)...(278): n = A,T,C or G
atcgagaactcttactacaagctncttgttctttttgcaggatcccatngattcnaattccgttgctgtcgccaaaatggcgcgggtgctgaaggctgcagccgcgaatgccgtagggcttttttccagacttcaagctcccattccaacagtaagagcttcttccacatcacagcccttggatcaagtgacaggttctgtgtggaacctgggtctactcaaccatgtatccatagcagtccaaattngnantntgctgttnnaatntatnacaatat

SEQ ID NO: 1487 - DNA, 300 bp, Homo sapiens
aattccgttgctgtcggggagtccttgttgccatccatccctagggggtaattttgttccctgaggctgctttctagggacttctggtcgcttgttttatcctggaccagacctgaaagcagagcctgaaataaggccttctatgcacatcatttatgtaggaggtggccctaggaagcaggcccaatgcgccatgggaaaaaccagtaccagggtgttttgctgagttgagcactgtggtgggcagctggacatgagcccactggaatcttctgaagagcccaagagcctcttctcagt

SEQ ID NO: 1488 - DNA, 300 bp, Homo sapiens
aattccgttgctgtcgggcggcaggtgatgcagtttggacggattgatggcagtgcgtacattctggacttccagtatccgttctcagccgtgcaggcctttgcagttgccctggccaacgtgactcagcgcctcaaatgaagagactggtgtggggaggagagagatgcagagagcctttggaagaggtcttcggagatgccagaggagccctctaggggtccgatgcctgggaggaccacaagccaacagcaaaactggaaaagcccggcaggcccaggagagggcgctgacctgtgg

SEQ ID NO: 1489 - DNA, 300 bp, Homo sapiens
aattccgttgctgtcggacggaaaccatgtttgtggctcgcagcatcgcggcggaccacaaggatctcatccacgatgtctctttcgacttccacgggcggcggatggcaacctgctccagcgatcagagcgttaaggtctgggataaaagtgaaagtggtgattggcattgtactgctagctggaagacacatagtggatctgtatggcgtgtgacatgggcccatcctgaatttgggcaggttttggcttcctgttcttttgaccgaacagctgctgtatgggaagaaatagtaggag

SEQ ID NO: 1490 - DNA, 300 bp, Homo sapiens
aattccgttgctgtcgcaaaaaacaacaacaacaaaaaaaaactgttaacaatttttctgtctgtgttcatgaggtgtgttagtctgtttttggttccttgtaatgtcttttttctgagttatttgctggcccttccctttaattttctgcaagagtttgtagaaaattgtattacctctcctgaaatatttgctagaattcactagtgaagctgcctggggctggagttttctttaatatagagctgttcagatagtctgtttattcttttccgtttctgaaagtttgcatcttttaag

SEQ ID NO: 1491 - DNA, 268 bp, Homo sapiens
  misc_feature (1)...(268): n = A,T,C or G
aattccgttgctgtcgtggagatggagcggatgatgcaggcgggcactcccatgggcatggagtttggtggaggccggggcctcctgagccctcccatggggcagtctgggctgagggaggtggacccacccatggggccaggcaacctcaacatgaacatgaatgtcaacatgaacatgaacatgaacctgaacgtgcagatgaccccgcagcagcagatgctgatgtcgcagaagatgcggggccctgnngacttgangggcccca

SEQ ID NO: 1492 - DNA, 300 bp, Homo sapiens
aattccgttgctgtcgaacgtcttgaagaatagtgaaaagtcaaagtttcaacagcatgtgcctttccgggaaagtaaactgactcactattttcaaagtttttttaatggtaaagggaaaatttgtatgattgtcaatatcagccaatgttatttagcctatgatgaaacactcaatgtattgaagttctccgccattgcacaaaaagtttgtgtcccagacactttaaattcctctcaagagaaattatttggacctgtcaaatcttctcaagatgtatcactagacagtaattcaaa

SEQ ID NO: 1493 - DNA, 300 bp, Homo sapiens
aattccgttgctgtcggtggagtggtccggggatggcagtgggaccctgcagaggagtggctctcttggcaagatccgggatgtgctccgcagaagcagtgaactcttggtgaggaagctccaggggactgagcctcggccctccagcagcaacatgaagcgagcagcctccttgaactatctgaaccaacctagtgcagcacccctccaggtctcccggggcctcagtgccagcaccatggacctctcttcaagcagctgacattcaacccggcccccaggtctgctgggtccccccac

SEQ ID NO: 1494 - DNA, 252 bp, Homo sapiens
  misc_feature (1)...(252): n = A,T,C or G
aattccgttgctgtcgtggagactttgattcgaagcccagttgggccgaccaggtgggggaggtgtgagaggttttacnnagatctnacttgctagtccacaaatgccacatgtggacatgcnnacccactcaccctgtgctgnctccacatntgtcaagccctgaaacgcttcacaagacagacttttctcttcgaagggaaaccctatcttgcattttactctacgctgntctttttttttgagacttga

SEQ ID NO: 1495 - DNA, 262 bp, Homo sapiens
  misc_feature (1)...(262): n = A,T,C or G
aattccgttgctgtcgatgaggtgctggtgtgtggatggatgaggtgctggtgtgtgggtggatgaggtgctggtgtgcggatggatgaggtgctggtgtgtggatggatgagatgctggtgtgtggatggatgagatgctggtgtgtggatggatgaggtctgtgtgnatnnatnaatnnctattnctttnnncctnaangcnntnnttcatttntantattatnnncnttnctttcaaactnntnttnncattattatnt

SEQ ID NO: 1496 - DNA, 300 bp, Homo sapiens
aattccgttgctgtcgccggcctcctatgccttctttccgggcctgttttaagagcattttcagaatacacacagaaacaggcaacatttggacacatctcttaggttgtgtattcttcctgtgcctggggatcttttatatgtttcgcccaaatatctcctttgtggcccctctgcaagagaaggtggtctttggattatttttcttaggagccattctctgcctttctttttcatggctcttccacacagtctactgccactcagagggggtctctcggctcttctctaaactggatt

SEQ ID NO: 1497 - DNA, 300 bp, Homo sapiens
aattccgttgctgtcgcgacagcaacggtgacatctttcctcggctcctgtttggatcttcttcagatcttaatggaggcagatgttagcagggatgaaatacaggtgcctgtgctggatactgaggatgcgtggctctccgtggaaggaccaatctccatagtggaactggcccttgaacagaagcacatccactacccactggtggagcaccactccatcctgtgctccatcttgtatgcagtcatgaggttttctctgaagaccgtgaagccactttcactttttgacagtaaggga

SEQ ID NO: 1498 - DNA, 300 bp, Homo sapiens
aattccgttgctgtcggtttgcttaacagagtaaaaatgtttttaaaaagtttaaagtttataaagtaaaagcattacaataacctaattttaatttattatggaagaaagacatttttaaagataaatttagtttagcctaggtatacagtctaactatagctggagtcttcaacatacctctatcaacatttgataaaacaagccagaaatcatcaaggatatagaaccatcaccatcaaccagcagaatctcattgacatttatagaacacttcacccagcagcaggatacacattc

SEQ ID NO: 1499 - DNA, 300 bp, Homo sapiens
  misc_feature (1)...(300): n = A,T,C or G
aattccgttgctgtcggatttctactctgtctcctcaactctgttgatatttggggaaaattctgtttttcatagattctttgagatgctgatggaccagcttcagcatgtttgaggttgtctgaaatggagatcactgtaaaactgtctttttcttttaaattacaagtacactggggttaactgtattgctggaaaaacatcaagaatgacagtcttatatttaaggcaccagtcattggttccatttttttttttaattcttcccttggattaatatttnctactgaanagaaatga

SEQ ID NO: 1500 - DNA, 292 bp, Homo sapiens
  misc_feature (1)...(292): n = A,T,C or G
aattccgttgctgtcggagatatgcgggcaattcagcctgatgcaggttattacaatgatctggtcccacctataggaatgttcaataatcctatgaatgcagtaacaacaaaatttgatcctacatcaacaaattaagcaaagtgtcctgtattcttagtgctttggactaancaangaatacgnttanntacttgaccacttaccctcctatcantggtgnctaatncctatgttacacgatnaagacacaggtttannactttgcccatatagttaanttattgacaga

SEQ ID NO: 1501 - DNA, 297 bp, Homo sapiens
  misc_feature (1)...(297): n = A,T,C or G
aattccgttgctgtcgggctggagtgcagtggctcaatctcggctcactgcaaactccgtctcccaggttcacaccattctcctgcctcagcctcccgagtagctgggactacaggcacctgccaccacgcccggctaattntttttttttngggattttaantaaaancgggntttcatnatgttacccngnatggngctaatntccngacctggggatccncccntttngnccncccaatgggctggnattncnggcntgagccacnacncntagccttcccnatctatttttca

SEQ ID NO: 1502 - DNA, 300 bp, Homo sapiens
aattccgttgctgtcgaatctctgtattatagctatttgtctaacattaccccacatgtaataaataaaacaatatgagcataattgccccataaagaactcatgtcctgaattaataagtcttttcattgccagtcacttgtgcaatttatagagactatcaacttttttgcaccatatatgaaggaaacaaagtgcaaaaagtttgctctctcccttaagaaaattgagtgcttatagcctatgtcttccatataaaaaagtaagaatatcagtctttttaatgttattctaagaaaa

SEQ ID NO: 1503 - DNA, 300 bp, Homo sapiens
aattccgttgctgtcggagaaatccatcaacaaaattggccacgctctgcacgcccacgaccccgtcttcaagagcatcacacactccttcaaggtgcagaccttggccagaagtctgggcctccagatgcccgtggtggtgcagagcatgtacatctttaagtctcccctcatcaggacgcctccttcctgtacacggagcccctgggccgggtgctgggcgtgtggatcgcagtggaggatgccacgctggagaacggctgtctctggttcatccctggctcccacaccagtggtgtg

SEQ ID NO: 1504 - DNA, 267 bp, Homo sapiens
  misc_feature (1)...(267): n = A,T,C or G
aattccgttgctgtcgacgcattctaccttttcctacaatgaatccaccagcagaaattcctgtacacatcttatcaacaaagaatttgaacctcaaagaattctcactgtgttacctaggctgcagtgcagnggtgcgatctcaactcactgcnacctntacctcctggnntnaancnnntctnctgtctnancnannntanntntcattntctacnnnncttnnttgnnnannctagtntntttntcntatntcatntctnccac

SEQ ID NO: 1505 - DNA, 293 bp, Homo sapiens
  misc_feature (1)...(293): n = A,T,C or G
aattccgttgctgtcggaggactgcttgagaccagcctggggaacatagtgtgaccttgttgctatgaaaaaaaaaaagaaaataanccaggctgatggcacatgcctcnagtcccagcttcacaanaggttgaggtnananaantgcttgacccanaagannaganncnatanngnnganattaanngnaggnnngcattntnctnnnntagnnncnnnctngacnnttgtcntnannattctncngtatttnnccaangaatngacnnatnaagnntnctctnctctaaat

SEQ ID NO: 1506 - DNA, 296 bp, Homo sapiens
aattccgttgctgttccgttgctgtcggcctaagcataaaaccaaaattataaaactcctagaagataacacaggagaaaacctggatgaccttgggttggcaatgactttttagatacaataccaaaggcatgctccttgaaagaaataattaattgagaagccagaaggcaaaatggtacagccattttggaagacagtttggccgtttctcacaaaactaaatatactcttaccataccatgcagcaattatactccttggtgtttacccaagacttgaaaacttgtgtctac

SEQ ID NO: 1507 - DNA, 286 bp, Homo sapiens
  misc_feature (1)...(286): n = A,T,C or G
aattccgttgctgtcggtttgatcccataaaacccaaacctccacaatctaaattgcttcgtgaagataagaaccataacatgtatgttgcaggatgtacagaagttgaactaaacttactgtacngnnttataggcacagtctaagaatncactattacctacaggnncngtaatatanaagaaatngnnntgaggganannnancactctttcttannaactnatcagcncnnntagatnttgggntaanaaaataccgggngaaaccnncataaaatgattaa

SEQ ID NO: 1508 - DNA, 300 bp, Homo sapiens
aattccgttgctgtcggtcagtttttctagattggcaatagcctgttgcaaagtgcctaaacctttgagaaaaattactatgagcaaggtccatgatttagttttcaatataaagggaattccattctatactgtaaaatccaaaaatgctagttgccctcagcttttgagttgacttccagaaagttgagatcttttgaccattttttctcgtgtcatataaaatgtgccacatggtagttgtcaagctgtggtagtcatgtacacttttttcttttttttaactttctaaaaggaaaa

SEQ ID NO: 1509 - DNA, 300 bp, Homo sapiens
aattccgttgctgtcggtgattctaattgaatgcagtgaactgagaggaattatgaactaccaggaggtggaggccctgaagcacaccatcaagctcctgacggtcattaaatggcatggaccaaaatgcaacaagttgaactccaagttctggaaacgtttacagtatgaaatgccttttaagaggatagaacccattacacatgagcaggctttagatgtcagtgagcaagggccttttggggagctgcagactgtctcggccatttccatggccgcggccacctccacagctctagc

SEQ ID NO: 1510 - DNA, 258 bp, Homo sapiens
  misc_feature (1)...(258): n = A,T,C or G
aattccgttgctgtcggtcggggtttcgtacgtagcagagcagctccctcgctgcgatctattgaaagtcagccctcgacacaagggtttgtcgaataattgcttcattttcttgagcaatactgaagcaggatgaagtaagaggaatgcattcattaaaacatgctttgctttatgaattnttggctctnttttatgtcnctnttnnntantnnnnnantttnattannntnannttattgttatntnattannana

SEQ ID NO: 1511 - DNA, 300 bp, Homo sapiens
aattccgttgctgtcggcctaagcataaaaccaaaattataaaactcctagaagataacacaggagaaaacctggatgaccttgggttggcaatgactttttagatacaataccaaaggcatgctccttgaaagaaataattaattgagaagccagaaggcaaaatggtacagccattttggaagacagtttggccgtttctcacaaaactaaatatactcttaccataccatgcagcaattatactccttggtgtttacccaagacttgaaaacttgtgtctacacaaaaatctgcacg

SEQ ID NO: 1512 - DNA, 300 bp, Homo sapiens
aattccgttgctgtcggtcggtcttcctccggcccgggccctggcccagctagccggccatggaagtgaagaaaatgtttggaagctctgtgaatacatcaaaaaccatgaccagtatcctttagaagaatgttatgctgtcttcatatctaatgagaggaagatgatacctatctggaaacaacaggcgagacctggagatggacctgtgatctgggattaccatgttgttttgcttcatgtttcaagtggaggacagagcttcatttatgatctcgatactgtcttgccatttccctg

SEQ ID NO: 1513 - DNA, 300 bp, Homo sapiens
aattccgttgctgtcgccagaggcagatgtgttgctgagcagaaatgacaaagaggtggtttctgtcccttgggcctgagggtccggtggcagagccagacatgacaacaatgtaaagcaccagcaaaatgtgatgtcaaagggaagcagaaatacattcaatctgataggaggacctaggaaggtctctgtgaagaacaggaaggattgcaccagaaagctcctgctgcttctgtaccccgcctgtccctcccagctgcgcagggccccttcgtgggatcatcagcccgaagacaggga

SEQ ID NO: 1514 - DNA, 295 bp, Homo sapiens
  misc_feature (1)...(295): n = A,T,C or G
aattccgttgctgtcgaagaggctgaggcgggagaattgcttgaacccaggaggcagaggttgcagtgagccaagatcacaccattgtactccagcctgggcaacagagtgagactctgtctcaaaaaaaaaaaccaaaaaanaaanaaaaanaaanaaggaaanaangggaaaggaaaggaaaanaganaganaaanananaaanaaanacncttcntttccgnaaagccagccgnattcntcccagcgtntttnttggngtctgnncatggataaagcctcccnattcccccg

SEQ ID NO: 1515 - DNA, 300 bp, Homo sapiens
aattccgttgctgtcggatgaagccatctggtcctgggcttttctgtgttgggaggtttttgattactgattcaatctctctcattattggtctgatcagactttccatttcttcatgattcaatcttggtaggttgtgtgtttcctctagaaattggtccatttcttctaggttattaaatttgtaggcatacaattcttcataatattctcttataatcctttttatctctgtcgtattggtagtaatgttccctctttcatttctgattgtagttattgaatgttctttttttttct

SEQ ID NO: 1516 - DNA, 300 bp, Homo sapiens
aattccgttgctgtcggtaacttaaatactatcgtataataatcatatcatataaaagtcagtgcaacttacattacatggtgagataagagagagaagaaaacaaaggtactgcttaatatacacattcacacagacatattcataataaaataggaggaaatacttacaacaattacaatcctcatttctgtagctgttcacatggtcgtggctggtatttataattactttgtctactatccaatctgtattccccttcccttcagaaagcgcctcagctgggcatggacccttacc

SEQ ID NO: 1517 - DNA, 300 bp, Homo sapiens
aattcgttgctgtcgcccggatgaagaggtgagctccccttcgccccctcagcgagcccagcgtggggaccactcttcccgggagcaaggccacgcccctgggggcacttctcaggccagacagattgatttcccgctgcggatcctggtccccacccagtttgttggtgccatcatcggaaaggagggcttgaccataaagaacatcactaagcagacccagtcccgggtagatatccatagaaaagagaactctggagctgcagagaagcctgtcaccatccatgccaccccagaggg

SEQ ID NO: 1518 - DNA, 129 bp, Homo sapiens
aattccgttgctgtcgggggattttgtgggaccgctgcccacagatccaggtgttggaagggcagcgggtaaggttcccaagccagacccaacacccttaccacttggcacccagagggggctgcacct

SEQ ID NO: 1519 - DNA, 300 bp, Homo sapiens
aattccgttgctgtcgatactctggtgaccagtggagtgtacgcttggtttcggcatccttcttacgtcgggtggttttactggagtattggaactcaggtgatgctgtgtaaccccatctgcggcgtcagctatgccctgacagtgtggcgattcttccgcgatcgaacagaagaagaagaaatctcactaattcacttttttggagaggagtacctggagtataagaagagggtgcccacgggcctgcctttcataaagggggtcaaggtggacctgtgacgggcagtggccccggtg

SEQ ID NO: 1520 - DNA, 296 bp, Homo sapiens
  misc_feature (1)...(296): n = A,T,C or G
aattccgttgctgtcgagaggagaacaaactggttgctgaagccatggtttccctgggaagggggacccacctgtgcggcacctggaattcagaggaagggctcncatncttgtgggnaaatgannaacatggccattannantgctggnatngngnangcncncntatctngacagnnactangnatncnaggnngactttnctgaatatgnngnannnnntttacnnntccctnntgnntgntacctgngtgcggntnctntgacaanctggtgcntnantncattccgaatca

SEQ ID NO: 1521 - DNA, 283 bp, Homo sapiens
  misc_feature (1)...(283): n = A,T,C or G
aattccgttgctgtcgtgaacttttggctgaacctcatcactcgaactccagcttcaagaatgtgttttcatgcccggcctttgttcctccataaatgtgtcctttagtttcaaacagatctttatagttcgtgcttcataagccaattnttattattatttttggggnactntncttcggaagattgccntgaagnntnnnnnaattaanagngactttngnanaanactnnnattanntangtnncnnnacntnannaanattnnangantttgaggagtt

SEQ ID NO: 1522 - DNA, 292 bp, Homo sapiens
  misc_feature (1)...(292): n = A,T,C or G
aattccgttgctgtcggctgggctgaccacgttactcatccccgttaacattctctctaaagagcctcgttcatttccaaagcagttaaggaatgggaaccagagtgttttaggacctgaagaatctttatgactctctctctttcactcttttttttttngccnntanntnaaanncaaagngnnngtttnancgttttngtnntcntcgggccccnngttncannnangggncaaangntttggntntaagncnatcccnccntnaanttnggggacnaattttaattcc

SEQ ID NO: 1523 - DNA, 269 bp, Homo sapiens
  misc_feature (1)...(269): n = A,T,C or G
ccggaatacctctactcggtcattttgcaggancccatngattcgaattccgttgctgtcgattgtcagtttgatatttattttaaattgtggaactagatgcataaattcacatttctgcctttcctttgcatcttctcatatattgtgtttttttttttttcccnaaaaaaananttaaanncattnttnancngnaaaaaccnnnnntntntgtancccanganttanncccggncnnanngnannnatnttaatgtanaatttta

SEQ ID NO: 1524 - DNA, 265 bp, Homo sapiens
  misc_feature (1)...(265): n = A,T,C or G
aattccgttgctgtcgaggagatgcagttcttaatgaagctgctcaaattctgcgattgctgcacatagaggagctcagagagctacagacaaaaatcaacgaagccatagtagctgttcaggcaattattgctgatccaaagtnanaccacagactgtnaaaagttggacgatnagtacntgatgnnntcngntaggtancnnnanctattatgncnanctacanagnctcggngccnngcagngctnnntncctnnattcttg

SEQ ID NO: 1525 - DNA, 300 bp, Homo sapiens
aattccgttgctgtcggtccagtgccaagagggcccggcaagaagaagtgacaatgaagtcttttcttgcggacactccctcctgtctcctattttctgtaaataattttctccttttttctctcttgatgctcaccaccaccttttgcccccttctgtctgactttataagagacaggatttggattcttcagaaattacaggaataatcatttttccttacccagttgtggcaagggccaggcaccacccatctaatgatgaagaaggacctaaaatttggtttgctaatacccaact

SEQ ID NO: 1526 - DNA, 300 bp, Homo sapiens
aattccgttgctgtcgatgagaataaagttagaatgagaatgttcctagcatggtgcctggcatgagcagattctcagcagatgggccctcctgtaatccgctgagggctctcctgcagtgccagcagggatcctagtcattgtctccaccactcctgtctgtcttcacccagaaccttgtctggatcctgggaggaagcaaacatctcctggtgggaatgtgaggccctgccaggttgtaggagtaactggaaaagggcaggtggccctgcccactatgtgggcacctcatgataaatg

SEQ ID NO: 1527 - DNA, 300 bp, Homo sapiens
aattccgttgctgtcggaaaatattattatgttagttttagcgtggaaattggaggctgaaagcatgggattttttaccaaggaagaatggttaaagggaatgacttcattacagtgtgactgcacagaaaagttacaaaacaaatttgactttttgcgctcacagttgaatgatatttcgtcatttaagaatatctacagatatgcctttgattttgcaagggataaagatcagagaagccttgatattgatactgctaaatctatgttagctcttctgcttgggaggacatggccact

SEQ ID NO: 1528 - DNA, 300 bp, Homo sapiens
  misc_feature (1)...(300): n = A,T,C or G
aattccgttgctgtcggaactgggttaggtgccgctgttgctgctcgtgttgaatctagaaccgtagccagacatgggactggaggacgagcaaaagatgcttaccgaatccggagatcctgaggaggaggaagaggaagaggaggaataaanggtaanaactggnttacanntgctttnatatgangaatcaaaggcnanancnctntgaggtagtnttacctnnacctgcgntntnctatgntcttttantgctgngttgaanggtntnannatnnntananatnnnaaanccagctg

SEQ ID NO: 1529 - DNA, 300 bp, Homo sapiens
aattccgttgctgtcgaaaagccttaatggccatgaataacctgagtgagaattatgaaaatcagggccggcttcaggtgtacatgaataaagtgatggatgatatcatggcctctaacctgaactcagcagttcaagtagttggactaaaatttctaacaaacatgactattactaatgactaccaacacctgcttgtcaattccattgcaaactttttccgtttgctatctcagggaggtggaaaaatcaaggttgagattttgaaaatcctttcgaattttgctgaaaatccagata

SEQ ID NO: 1530 - DNA, 261 bp, Homo sapiens
  misc_feature (1)...(261): n = A,T,C or G
aattccgttgctgtcgggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccatgccgtggattnatngatatgnatnntaanannannnngtnnnttaannaaagttcnnntanatnatnatnttaatcngnnattannnaanntntgngc

SEQ ID NO: 1531 - DNA, 300 bp, Homo sapiens
aattccgttgctgtcgccaagtccatgcgctccatgaatggctcgcggcggaacagtggctcctcgctagtgtccagctcctcggcctcctccaacctgagccacctggaggaggacacgtggatcctgtggggccggatcgccaacgagtgggaggagtggcggcgcaggaaggagaagctgctcaaggagctgatccgcaagggcatcccccaccacttccgggccatcgtgtggcagcttctgtgcagcgccacggacatgcccgtcaagaaccagtactccgagctgctcaagatg

SEQ ID NO: 1532 - DNA, 300 bp, Homo sapiens
aattccgttgctgtcggagcaattaaattcattgtctcagttcaagagtgaatatagcaacttatgtgaacctgagcagtttgtggttgtgatgagcaatgtgaagagactacggccacggctcagtgctattctctttaagcttcagtttgaagagcaggtgaacaacatcaaacctgacatcatggctgtcagtactgcctgcgaagagataaagaagagcaaaagctttagcaagttgctggaacttgtattgctaatgggaaactacatgaatgctggctcccggaatgctcaaac

SEQ ID NO: 1533 - DNA, 300 bp, Homo sapiens
aattccgttgctgtcggccggaaccacgaggagagcagtgagaccatgaatgacttgctggcccaggtggccactaacacggacaccagccgaaatgccggaaatgcggtcctgtttgagacagtactcaccatcatggatatccgctctgcagctggcctacgggttctagctgtcaacattcttggtcgcttcctactcaacagtgacaggaacattaggtatgtagccctgacatcactgcttcgactggtgcagtctgatcacagtgctgtgcagcggcatcggcccactgtggtg

SEQ ID NO: 1534 - DNA, 300 bp, Homo sapiens
aattccgttgctgtcgaaaataaagaggaaagccttttggaaaagcgcaggcagctgtctcgtgatattggtagattgaaagaaacatatgaagctctattagccagatttcccaatcttcgatttgcatacaaggatccagagaagaactggaatagaaattgtgtgaaaggacttgtggcttctctgattagtgtgaaagacacttctgcaaccacagctttagaattagtggctggagaacgactctacaatgttgtagtagacacagaagttactggtaaaaagctactagaaagg

SEQ ID NO: 1535 - DNA, 300 bp, Homo sapiens
aattccgttgctgtcggttctgcattagcatctgctggtgatcctggacatccaaatcatcctcttcacgcttctcagaattcagcgagaagagagaggatgactgcgcgagaagaagctagcttacgaacacttgaaggcagacgacgtgccaccttgcttagcgcccgtcaaggaatgatgtctgcacgaggagacttcctaaattatgctctgtctctaatgcggtctcataatgatgagcattctgatgttcttccagttttggatgtttgctcattgaagcatgtggcatatgtt

SEQ ID NO: 1536 - DNA, 242 bp, Homo sapiens
  misc_feature (1)...(242): n = A,T,C or G
aattccgttgctgtcgattttattttgatccttgttaaatttttattttaattaataaggtagtcattcctgtagagggataagatgcttgtagagttgtgggtatcattccaaatagaactgttatgatttgggaaatattctttactacaaaggacttatttcataattacaaattttccttcatatttgcctttgnnnataananntnnaggaangacattntntagcantannaggaa

SEQ ID NO: 1537 - DNA, 300 bp, Homo sapiens
aattccgttgctgtcggtgtgtgtgtgtgtgtgtgtgtgtgtgtatggagatgctgaaagagcattgataaaattctagactttcctaacaataaccccaagtaaaacaagaatagaagaaattgctaatgttataaagactacttgtataaaactaatgtctaaatagggaagcactaaagccatttcctttagaatcagaaacaaaacaagaatgcacattatcatcattattattcaacattgttttagaaattctagagactgcaatacacaagaaatgaaatattgggtatgaat

SEQ ID NO: 1538 - DNA, 260 bp, Homo sapiens
  misc_feature (1)...(260): n = A,T,C or G
aattccgttgctgtcggaaatgcaaggggctgcatgacctaccaggacagaactttccccaattacagggtgactcacagccgcattggtgactcacttcaatgtgtcatttccggctgctgtgtgtgagcagtggacacgtgagggggaggtgtgggagggttnnagtctgcnnggntnntgctcnntacntnncnntnctnctttnctaaccgncnnatnnnngcncatgnagantntntanngcactttnctnngtc

SEQ ID NO: 1539 - DNA, 284 bp, Homo sapiens
  misc_feature (1)...(284): n = A,T,C or G
aattccgttgctgtcgaaaatgcccagtcaggtctgaatcgtcagtgcattatattgactctgagcactttagaatttagagttgcaattgaatgccagctgtggagatggggtgcatatcagatatataaataaagctcangtttgttnnggaaccnngtattnnnaaanntncttntganntnttnntnnttnnantntntanagnnatnnctttntttntaaannttnnntnnagggnnatantngnnnttttgtnnatananncnnnanacctgtttttt

SEQ ID NO: 1540 - DNA, 300 bp, Homo sapiens
aattccgttgctgtcgcgcactccctctttctctcttttcctgtatctttcccttttaatttgctataggaaaaacttaaacatgagtgagcaaagaggaggatgcaactgaatatttttggaaatgtggatatcatataagggcttggaagatcaacactgggatgatgatgagcagaatggtcatgaagatgcccaaaatcagggcccagatgttcaggcacttggcggtggaggcataggcctgggcgccagtcaggtcgccaaccatcttcctgtgcctagacttcacggagtaag

SEQ ID NO: 1541 - DNA, 300 bp, Homo sapiens
aattccgttgctgtcgggcacgtcctcgtgtatcctgtggaggaccctgaccccgcaccccaccctcgaggccagaaatcggttgcctctggggacctgagaagcgagaccactcgcgcccctgacttgcaagttggggtctttattggcctccgggattctgctcgtggcggtttctccaggctggtgatgggcaagccgggtgtaccaagtccaggatgcacatgaggagccgtttgtaaccgcactgaatcacctcatgactagcggggcaggcctctaattcaccgcaggaatttc

SEQ ID NO: 1542 - DNA, 265 bp, Homo sapiens
  misc_feature (1)...(265): n = A,T,C or G
aattccgttgctgtcggattctccccctcttgaaaaaaaatcgatttttcaggatttaattaatacaaaccttattttaggttggtgcttaactggaggtgatgcataagtctgatttttttttccaagatagaaaaagcatttatcctaacaaattggtattttttataagcctccatgtggctctgaatgcaagctatatatagtgagtttttctaaattaagggaactctgctttttttttttttttttaaanaancgggnc

SEQ ID NO: 1543 - DNA, 300 bp, Homo sapiens
aattccgttgctgtcggtggaggggcccgttcgaagagtcgtgagggggtgacgggttaagattcggagagagaggtgctagtggctggacttgacctggaaagaatcttctgctgactctcaacttttcctggaaaaaatggatcattcccaccatatggggatgaagctatatggactccacagtaccatgcaccttttcaccataccccaccccttcaccttacactcccatgggggaaggagacagcagcatgatgatgatgcctatgacctctacttggctttaagaatgtggac

SEQ ID NO: 1544 - DNA, 300 bp, Homo sapiens
  misc_feature (1)...(300): n = A,T,C or G
aattccgttgctgtcggaatatgatactttggaggggaaatgcttggcgtgtgtacaagtatgaggagaccaacttacacaacccatcaaatacttatgctcctcatagccaaggaggtattccacctcctgctggaatgtaattaaagggagaaacacactgtatgaaatatatgtctatatcatgacttgttgccaacatcttgaggcacattatttgtttccaataaaagtaatgttttttttttttaancccccantgagatatcacctcacacccatcagantggctactgtaaa

SEQ ID NO: 1545 - DNA, 267 bp, Homo sapiens
  misc_feature (1)...(267): n = A,T,C or G
aattccgttgctgtcggtttccactattgacactgcccggctgattcaagcttttggccatgaaagagtatgcttgtcacccagacgaattaaattatatagcagcatcaccaaccaacagaggagataccttgagaagcggagcaaacacagcaagaaagtgntgaagactggncantcccctatngacttntgatcacaccagaangnatcncattcaagnancnnnccatntatanttnnccttacnntaannnnntnnctngc

SEQ ID NO: 1546 - DNA, 300 bp, Homo sapiens
aattccgttgctgtcgggagtaccgggattctgatggaacctcatctgtttgaattactagcccagagggtcatcactctttacctgcaaacagtaccttctctgatgtctgggagaggtggtttatttcccatatacttgttaagtgtagatcttggggaagaacaactaacaccagaaacatcacatgttggctgttggggaggtgcttgtccattttgtatcccttttattttttcccaatcaacagagatccagttagaaggagcagcaagaccttccaggaggccatgctggaag

SEQ ID NO: 1547 - DNA, 300 bp, Homo sapiens
aattccgttgctgtcgcagtgagcgggtctgggcggctgctggcagcgccatggagacggtacagctgaggaacccgccgcgccggcagctgaaaaagttggatgaagatagtttaaccaaacaaccagaagaagtatttgatgtcttagagaaacttggagaaggattactgtagatgcagtatatggaatcaggaatcttaacttcatgtgagctattggagtttcctttgctatcaggatcataagggagggtctatgcagcgtatacaagctattcttaaggagaccggccagatt

SEQ ID NO: 1548 - DNA, 300 bp, Homo sapiens
aattccgttgctgtcggttctgttttgtttttggtttctcccttgtgtcagttctcttctggcccagctgggtggctgtggaagtctgtgaggtggcccaaccacaagcatacctattaagagaagcccagagcttccagcccccacttcgaaaactctctctggcccacatagcaaactccttcttccgtatttttcccaaccccagaatttttttaaaaaggccactttgccggaaccttctttgggccattttggtttccaatcaagcccaaggttatatgaataaagggggttaac

SEQ ID NO: 1549 - DNA, 300 bp, Homo sapiens
aattccgttgctgtcgagcactctatgttcgttatctcatttgctctaagtatgtaaatagggaactgatgaataaaaaggtgagtgaaatgacttggtcacaaaaaaagtgataaaaatggggattacagttcagtttcattgactcttagaattttttctccttctccccagcttttcattttgaaaaaattcctaacatacagtaaagaacagaacaacaagcacctagattaaatagtcattaatgttttgccatagttgcttgatttttctttctacacacacacacacacacac

SEQ ID NO: 1550 - DNA, 300 bp, Homo sapiens
aattccgttgctgtcgcttttacggaattaagcagagaaaatgatgaagagaaagtcacgtttaatttgagtaaaggagcatgtagctcatccggagcaacatcttccaagtcaagtactctgggaccgagtgcactgaagacgataggaagttcagcatcagtgaaacgaaaagaatcttcccagagctcaactcagtctaaagaaaagaagaaaaagaaatctgcactggatgaaatcatggagattgaagaggaaaagaaaagaactgcccgaacagactactggctacagcctgaa

SEQ ID NO: 1551 - DNA, 300 bp, Homo sapiens
  misc_feature (1)...(300): n = A,T,C or G
aattccggtgctgtcgagcctctagacattgcggccgctatctacgtagatccagacatgataagatacattgatgagtttggacaaaccacagctagaatgcagtgaacaaaatgctttatttgtgaaatttgtgatgctattgctttatttgtaaccattataagctgcaataaacaagttaacaacaacaattgcattcattttatgtttcaggttcagggggaggtgtgggaggctctnatgtccaccagnagttgttcnacccctcnccangtnccaggtgggatcacctgatac

SEQ ID NO: 1552 - DNA, 244 bp, Homo sapiens
aattcaaggcctctcgagcctctagacattgcggccgctatctacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggggaaggttta

SEQ ID NO: 1553 - DNA, 300 bp, Homo sapiens
aattccgttgctgtcgggtagaaatgggtccatttaaacatacggttgatgatggtctggatattagaaaggcagcatttgagtgtatgtacacacttctagacagttgtcttgatagacttgatatctttgaatttctaaatcatgttgaagatggtttgaaggaccattatgatattaagatgctgacatttttaatgttggtgagactgtctaccctttgtccaagtgcagtactgcagaggttggaccgacttgttgagccattacgtgcaacatgtacaactaaggtaaaggcaa

SEQ ID NO: 1554 - DNA, 300 bp, Homo sapiens
aattccgttgctgtcggccttgttacagcaaatactatcgatcagaaaattgtggaaagagcagctgctaaaaggaaactggaaaagttgatcatccataaaaatcatttcaaaggtggtcagtctggattaaatctgtctaagaatttcttagatcctaaggaattaatggaattattaaaatctagagattatgaaagggaaataaaaggatcaagagagaaggtcattagtgataaagatctagagttgttgttagatcgaagtgatcttattgatcaaatgaatgcttcaggacca

SEQ ID NO: 1555 - DNA, 299 bp, Homo sapiens
  misc_feature (1)...(299): n = A,T,C or G
aattcaaggcctctcgagcctctagacattgcggccgctatctacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggagntttcccntaatntaananctnnatgncnctagnatgttacatgatgncnngnncctgtgct

SEQ ID NO: 1556 - DNA, 291 bp, Homo sapiens
  misc_feature (1)...(291): n = A,T,C or G
aattcaaggcctctcgagcctctagacattgcggccgctatctacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggntttgnccccctntggcctttcctancanccttcnaacctnacnnnacacctc

SEQ ID NO: 1557 - DNA, 300 bp, Homo sapiens
  misc_feature (1)...(300): n = A,T,C or G
aattccggcctgtcgagcctctagacattgcggccgctatctacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggagggttttacaatgtccgctccatgcccatccgcaaggacgacnaggccaggtagntcnaggacac

SEQ ID NO: 1558 - DNA, 300 bp, Homo sapiens
  misc_feature (1)...(300): n = A,T,C or G
aattcaaggcctctcgagcctctagacattgcggcccgctatctacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttantnctagnnanatnttgnanatnattncttttaatcnnngnattntaattacatgt

SEQ ID NO: 1559 - DNA, 291 bp, Homo sapiens
  misc_feature (1)...(291): n = A,T,C or G
aattcaaggcctctcgagcctctagacattgcggccgctatctacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttaancangntcttgatgaatgtgctttgtgccaaaatgcctncccattgt

SEQ ID NO: 1560 - DNA, 297 bp, Homo sapiens
  misc_feature (1)...(297): n = A,T,C or G
aattccgggctgtcgagcctctagacattgcggcccgctatctacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggnaggtttttctggacagttcacgctgncaatgaaatgngacctatgntatccattgtcctgga

SEQ ID NO: 1561 - DNA, 300 bp, Homo sapiens
aattccgttgctgtcggttggttcgtcacaaggcatcgcagaaggtttatgctatgaagcttcttagtaagtttgaaatgataaaaagatcagattctgcctttttttgggaagaaagagatattatggcctttgccaatagcccctgggtggttcagcttttttatgcctttcaagatgataggtatctgtacatggtaatggagtacatgcctggtggagaccttgtaaaccttatgagtaattatgatgtgcctgaaaaatgggccaaattttacactgctgaagttgctcttgctc

SEQ ID NO: 1562 - DNA, 300 bp, Homo sapiens
aattccgttgctgtcgctgtcagccacaatgccttctgatgtgcttgaggtgaccaagaagttcatgagggaccccattcggattcttgtcaagaaggaagagttgaccctggagggtatccgccagttctacatcaacgtggaacgagaggtggggcccagtgcaggaggcgggcctggtagtgagttgttgggtatagcccctgactgatttttgtcccccaacctccaggagtggaagctggacacactatgtgacttgtatgaaaccctgaccatcacccaggcagtcatcttcat

SEQ ID NO: 1563 - DNA, 300 bp, Homo sapiens
aattccgttgctgtcgggccctgtcctgaaccagatgagaaactttgggatcctgtcggttactactattcagatggctcccttaagatagtacctgggcatgcccggtgccagcccggtggggggcccccttcgccacctccaggcatcccaggccagcctctgccttctccaactcggcttcacctggggggtgggcggaactcaaatgccaatggttacgtgcgcttacaactaggaggggaggaccggggagggctcgggcaccccctgcctgagctcgcggatgaactgagacgc

SEQ ID NO: 1564 - DNA, 300 bp, Homo sapiens
aattccgttgctgtcgaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaaccagggaatactattaaaaagcagtt

SEQ ID NO: 1565 - DNA, 300 bp, Homo sapiens
aattccgttgctgtcggatgctcagagtgtagtggatatttatgtaaactatgactgtgacttaaatgcagccaatatatttgaaagactagtaaatgatctatcaaaaattgctcaaggaaggggcagtcaagaacttggtatgagtaatgttcaggaattgagcctgaggaaaaaaggtttagaatgcttagtgtcgattttgaagtgtatggttgaatggagtaaggatcagtatgtgaatcccaactcccagacaactcttggtcaggaaaaaccctcagagcaagagatgagtga

SEQ ID NO: 1566 - DNA, 1076 bp, Homo sapiens
  misc_feature (1)...(1076): n = A,T,C or G
cncangttntngaaaaccccctttttgggnaaaaaactccccccnggtntnctttttttttggncaaggggaatacnccaancccgcaatttccngnanaggtnnaggggggnanggganggcaggggaanngagnccggggcttggcntncngaaaaccngnanttttttgtgggacgggggggagggcncnggggggaccggaataaaagcngggggntgggggaaaaggnaantnggttttcaaaggggaatccaaaaacggggcgnaatggttagangggnggaccctnggnccctggggggaagngnnacnngaatttgnaaaggganggnnnaaatcnngggaangtcccnggaanaacgggganaagggggcccangagggangggctccccaagnggattttttaacggacacatggaacgaagnaaggtttgtnnggagggctcnaaaatgngccngggaanggggcnntccangnggggngggtanngtaacannntcncggacaanatgggnggccactnantngaaaannaatcttgttgctattaaaaaataaagctgacccancgggngaagtngctnaatggggaatgcaaantnnttgaggggnccngggngacgnnactaaattgnggtcaaattnttgaananacggnnaatgggngaantggcaagtganngnaacctantactcaangannttttattgatnggnnaganggagnaagaccttgggaagaanccnncttggggcttatgaaacggggaataaaatagggggnaangtggcnatccntttcttggggacangggaacttgctcaggggggaaanggaacatggaggcggggnggcgcaagggncctgctcaatngngttcttaatgnnanccttgncttaaaanggagantaangngaaanaagtgggggnnattgttggnnaantntatttggggggaatantgggcacgggctnaataaataanngcncgnaggcccataangggaggccncnangggnaccccntggannattgggcagangnanctttntnannnaggttaan

SEQ ID NO: 1567 - DNA, 745 bp, Homo sapiens
  misc_feature (1)...(745): n = A,T,C or G
cttggctttttgcaggatcccatcgattcgaattcggcacgagcagagcttagacatccaaaactaatcaatgctgaggtggctaaatacctagccttttacatgtaaacctgtctgcaaaattagcttttttaaaaaaaaaaaaaattgggggggttaatttatcattcagaaatcttgcattttcaaaaattcagtgcaagcgccaggcgatttgtgtctaaggatacgattttgaaccatatgggcagtgtcaaaatatgaaacaactgtttccacacttgcacctgatcaagagcagtgcttctccatttgttttgcagagaaatgtttttcatttcccgtgtgtttccatttccttctgaaattctgattttatccattttttaaggctcctctttatctcctttcttaaggcactgttgctatggcacttttctataaccttttcattcctgtgtacagtagcttaaaattgcagtgattgagcataacctacttgtttgnataaattattgaaatccatttgcaccctgtaagaatggacttaaaagtactgctggacaggcatgtgtgctcaaaggacattgattgctcaaattttaaggaaatgggnccaatgaaccgtnggttgtggggaaggggaaagangaaaccngagcttggtcanaatgtggaaatnggatctggtggnaataaacatgtttaaaaccaanccnnnnnnanaaaaaaaagncctttttta

SEQ ID NO: 1568 - DNA, 674 bp, Homo sapiens
  misc_feature (1)...(674): n = A,T,C or G
acgaggctgcatctgnnnnnaggatgccaccctacgctgcgctggctgcgatggggacctcttctgtgcccgctgcttccggtgggtgcaggtggaatgttctgtgcgagagctcaagggctgcctggatccctgacttgtatccctttgttccacagagagggccatgatgcctttgagcttaaagagcnccagacatctgcctactctcctccacgtgcaggccaagagcactgaagacaccctggtcctcccggaagggcagtcccacaggcagcggcacccatttctgggccccgccacaggacgtccgatgggagagcttgtctggctctactgatgatggataggccccttcctgagccttggtgtccctggaatgaggaaagattctccattcgagagaatgactgggagggaagaagtcggggccctcctattagaagcccagactggaagtgagaggcatgatggggagagaccagactgaatctacgggtgagccctgtaacctggctctagggcacangcccctccctggcacttantgggtctaataaagtatgttgattcattgggaaaaaaaanccnntcntngntnnannnaananncctccccccccttaaaaaanttntngggggggnnttttccctnancccnnanttnaaaaaan

SEQ ID NO: 1569 - DNA, 747 bp, Homo sapiens
  misc_feature (1)...(747): n = A,T,C or G
gnnnnnnnnnnttnnanncnannncnnatcgantcgcacgagctgcatctgcaatgaggatgccaccctacgctgcgctggctgcgatggggacctcttctgtgcccgctgcttccggtgggtgcaggtggaatgttctgtgcgagagctcaagggctgcctggatccctgacttgtatccctttgttccacagagagggccatgatgcctttgagcttaaagagcaccagacatctgcctactctcctccacgtgcaggccaagagcactgaagacaccctggtcctcccggaagggcagtcccacaggcagcggcacccatttctgggccccgccacaggacgtccgatgggagagcttgtctggctctactgatgatggataggccccttcctgagccttggtgtccctggaatgaggaaagattctccattcgagagaatgactgggagggaagaagtcngggccctcctattagaagcccagactggaagtgagaggcatgatggggaaaagaccagactgaatctacgggtgagccctgtaacctggctctagggcacagcccctcccctggcacttantggggtctaataaagtatgttgatcattggganaaananncncnnatcnncncnncnnncnccctccccntnaaaactttgggggccntttcntcaacccccnctttaaaanacnttgnngttnnnnaccccctcttanntnnnnnnnttnctctcccnccn

SEQ ID NO: 1570 - DNA, 754 bp, Homo sapiens
  misc_feature (1)...(754): n = A,T,C or G
gnggnnnttnnnnnnnnngnnngnnnnnngngngnnnnttctaatgcttccaacagncncnggggctcgaactcgctccacgcagccnggcngtgngaattcggcacgaggacngcacacntcacggggtgccctcccaacnctncgcatgcgagacccngngccaatatcggggggntcaatgaccannngggctcagcatgganaaacagngccctgcctgaagggcagnnagaatcaaaaggatcttacccctngtatcangagggnggctatgctccctccatnccaagnngagcccnggactagaaagcacgatgncgncnnacatctactgnnancgcctaaacanaatccctnctccntgangggcnaaacgncctcatcccnaatncaacantgggcnngaangactgaaaatcgccggaactcancaccatgatcggaccgggacantcagaccctntcctgccncancnancgncnatcgatccgaaaagtgnanntatnagcacaacnacgggganggcatanggaccctgcnagaaagaacnngcncnnnctcncnnggactgccatgaaggntagcngcctaaaatcnnnncctgacactcggaggnccgccacaannngnnnaagnnanggcnngacgnnacactggntgaaaaaaannnngnngnnncnnggnaaacccnngcccnnnnnacnnnnnngngncgnannccnngcccccnnnnacgatnggnncccnngc

SEQ ID NO: 1571 - DNA, 761 bp, Homo sapiens
  misc_feature (1)...(761): n = A,T,C or G
ttaatanatccttgtattggcngatccatcgattcgggcgaaaatcgaaatcaagttatccgatattccagaaggcaagaacatggctttcaaatggagaggcaaacccctgtttgtgcgtcatagaacccagaaggaaattgagcaggaagctgcagttgaattatcacagttgagggacccacagcatgatctagatcgagtaaagaaacctatcangataacccattcaggtttctttactcgatctagatcatgtaaagaaacctgaatgggttatcctgataggtgtttgcactcatcttggctgtgtacccattgcaaatgcaggagattttggtggttattactgcccttgccatgggtcacactatgatgcatctggcaggatcagattgggtcctgctcctctcaaccttgaagtccccacgtatgagttcaccagtgacgatatggtgattgttggttaagagacttggactcaagtcntaggcttctttcagtctttatgtcacctnaggagacttatttgagangaaccttctgtacttgaagttgatttganatatgtaagaattgatgatgtatttgcaancattaatgtgaataaattgaatttaatggntgaatactttcaggcattcacttaataaagacactggttaaccactgntatgctcaatcatacccnctaaaaggtacaaatggcctttttacctaatnctaattnaaaaattnccngactggnggtaaaaaaaaaa

SEQ ID NO: 1572 - DNA, 712 bp, Homo sapiens
  misc_feature (1)...(712): n = A,T,C or G
agnttcgaattcngccgaggttacatcaagagataaatagagtgaagcagaactagtggtgcggaccagctcgccagcaacagaagggtttgtagtcggcctggcagtggacagggaggttggctagaactattaccttaggtccgtgataatatccctgaatccaacttttcagaaagaaataggtaacatatttttcaccaggaagcttcacccagacactgaacagaatggtctcagtgcactaatggaggctcagttaaagggttgtggtagcacaaggaagagacattctgacttggaaatttggagaaggcttcacaaatgaaggggcatttgaaatgagctttgaaggtgcaagagtattccaagttgagaagacaacctgagtggtgttgggtgaacagtcattctacctggctgtagtgtagtatagtgtagtgtagtgtaggaaacatcagaggagtggagtgggatatgagcctggagagagctggcggccatggatcattgaaagccttgaatgtctgatggggaggttgactttattttgtaggcaatggaaaccaccatggtttttagttgagcagcatgaaattaagcctgtgctttgcaaagattaatctancaccaccagattgaagccacaccccatttctggtataatccagtaaatatatacactntttctgtattggtccataaaggcttt

SEQ ID NO: 1573 - DNA, 1259 bp, Homo sapiens
  misc_feature (1)...(1259): n = A,T,C or G
ttcnacnnncaantnncnnntcgtnttatntancaangtattnngnncangntanntntcatatgtnnaaaacnggnnncgnttantantanacnctannnntannganangtncncttntanatctgtgncaaatatatcgtnangtgaactcanngnnnacacnacanatntnntngtanacncannnccagantncttgaactntctnncacaancatnnngaaanaaatacntagtnntnccaatttattgatcgnantnngcacgagaaaacaccntncatggcacctcgtttggnncaaataaggctatgtttttgaaagtaacctttccacaagncaataacagaagctatggtgaaatgtaaaaattcacaattctactttgtttcactgagtgcccaatcaacgattcatacagttgagatgaatgtgacaaaactctctatagataaatatatattgcctaagtttatctatatatatatgtctttgtgtgtaatattcatacacagatatattgcaanaganattaaatantcttncttacataaaccancnntaggatcattntnncagggaatatgaganttacacncataggntcctatgantggancatnnagacatatnataaacnntttangaaaagantangccattnnatntctcctgatntcatnaacttnannccncantnanttcncancanctnntttncatctncttangntngcnctnannnnantnncaattcntagtatggactctnntttnncgancaganngtntncttcatntccnaatntantatnanctaacanaatntggnnatatnntgccatntanntccgnaanacgcatatnatnncgtagnaccnacngtntcacntntnctcncttatctaccacattgatcgtnntagcancggtcgttacantntntcatatacatcgnanatctcgcnatntcnacatataattanannnnantatnnatgnnaangtnctctnatatgangtgcacataattcatncgagtncacgntntanatnnacatanantntctactgttttannccgncatgtcagnatatgtttcgagntcnctnnntcatcgannnacgncgtgcntntctcacgtctnttatcgnctnntatcatgcncnatttnntcntctgtantcattntatgcatatanagtgacgnacnnatctcnatcattttcatattntttnctcgttancanactncn

SEQ ID NO: 1574 - DNA, 768 bp, Homo sapiens
  misc_feature (1)...(768): n = A,T,C or G
gnnnnntttnagatcngctctttcntatntgcaggatccctcgattcgaattcggcacgaggtcccaggaaattcctccccttattcttccttgaagtgcccgagcatgtagggcaagaaggaaggctgaagcgctgtccctaggaggaatttctccttcaggggagcctcagttttgcccatttatctaattgaatcagttttttacccaatcccccgattttgtaggataatctcccttatctaaagtcaactgattatggactttaatcacatctacaaaacacttccatggcgacagctagatgagtgtttgaataactgggactgtagcccgtccaagttgacacataaaactgaccatcgggccgggggcggtggctcacgcctgtaatcccaacactttgggagcccgaggcgggcggatcacaaggtcaggagttcgagaccagcctggccaacacggtgaaaccccgactctactaaaaatacaaaaaattagcccgggtgtggtggcacacacctgtagtcccagctactcgggaggctgangcaggagaatcgtttgaacctgggaggcagaagttgcagtgagccaagatcacactattgcacttccancctgggcgacagggcaagaactctgtctcaaaaaaaattaaaactgaccatctagtccttggcatctgggcacccttnaaaaaaagccttntagaactatagtgagtcgtatttacgtagatccagacatgataagatccattggtg

SEQ ID NO: 1575 - DNA, 752 bp, Homo sapiens
  misc_feature (1)...(752): n = A,T,C or G
tcagctctntttatatatgcaggatcccatcgttgcnnnttctgcacgatcgtatcanganattcctgcncttattcttccttgaagtgcccgagcatgtagggcaagaaaggaaggctgaagcgctgtccctaggaggaatttctccttcaggggagcctcagttttgcccatttatctaattgaatcagttttttacccaatcccccgattttgtagggataatctcccttatctaaagtcaactgattatggactttaatcacatctacaaaacacttccatggcgacagctagatgagtgtttgaataactgggactgtagcccgtccaagttgacacataaaactgaccatcgggccgggggcggtggctcacgcctgtaatcccaacactttgggagcccgaggcgggcggatcacaaggtcaggagttcgagaccagcctggccaacacggtgaaaccccgactctactaaaaatacaaaaaattagccgggtgtggtggcacacacctgtagtcccagctactcgggaggctgangcaggagaatcgtttgaacctgggaggcagaggttgcagtgagccaagatcacactattgcacttcancctgggcgacagggcaagactctgtctcaaaaaaaaattaaaaactgaccatctagtcctttgcatctgggcaccctnaaaaaaaaagcctttagaactatagtgagtcgtattacgtagatccagacttgataagatncn

SEQ ID NO: 1576 - DNA, 767 bp, Homo sapiens
  misc_feature (1)...(767): n = A,T,C or G
gaattcgnnnncagacaagaaaaatgattcaaaaaantnttgagccacttttggataaggaatcaattttttagaatcctactttggatttaccttgttctatagggagaactgagggaactgcacattcatccagtacctcagatgtggatttcacgggtgcttccagtgcaaaagaaactacctcgtctagcatttccaggcattatggattatctgactccagaaaaagacgcgtacaggaagatcttggcctgctgcaataccacatttgcggagaagaagaggtcgtcttccaagaagagcactccagactcagaactcagaaattgtaaaagatgatgaaggcaaagaagattatcagtttgatgaactcaacacagagattctgaataacttancacgatcaggagttncaactcaatcatctaaagaactccattaccaagttattttggtgctgcaggtagaatagcatgtggcgaaaaatcccgagttttggcacgtcgggtgacacttgatggaaaggtgcagtntcttgtggaatggggaaaggaccaactgcatcctgactgtaaggacngaacattatgttccactgcactctgattttctgtanggtaccagttccaaacccctaaaggagccnnggcttntactatttttnttttaaaancaanantncncaccncnctttnccccntatntccnntcnnccccccnnnttccnntcccccttccctnctnctnctctncccccacncccn

SEQ ID NO: 1577 - DNA, 1000 bp, Homo sapiens
  misc_feature (1)...(1000): n = A,T,C or G
annnctntncnnacatcngnnnnntcnnctnattcaaanccttttcaatntcnctnacgnntcataatnattnnnnnncnnnnnccnatnttnttnnatcanntntttttnatatnancatattnttacaatnccttattanannaatntntntntccntnctttanaacancntcntccnannaanttcnnntattttaattncctcnnacccnacctattncnattcaanatntancnaattnntanctnnnnaatntactaaacncanacncatnaccactantacctnnaatntacatcannctatttnntantcccttatannctancnttcttatcatantacnnctatntattctactcttnancatatctcanctcatcncnncnaccntctatatntattttnnttcncataaaattcttattcttcaancannaaaatcacatttnattncactatctcaataaaaantnnnactccntcnaatcctctctaacaatnattacattacatatnaattaaantcantctnctnattcanaatcatctattcntcccactataantatntcntcttcanttatantantntnnnattcnttccatttattantctcantacatactanatntanctatcntccnttccttaactcnctactncnnatanaatanaannttcaaattcantaatacantcataannctaaaanacaaataatntaanttatantcccacaccactnanccntataantattcntntatattctaatcatncntntattcttcnacnttttcattnncannnttcaantnatctantanatatttnttntanntcactcnntanctttatnantanttntnttttananacantataccntctaacnatnatctttntcntacttnaantctncatattnatcatnnntncatnatnactatttnaaaatcntatcacancttctancacactncnctntnncn

SEQ ID NO: 1578 - DNA, 727 bp, Homo sapiens
  misc_feature (1)...(727): n = A,T,C or G
anntcaatcgnacgagactgttcagttctggcttgaaaatgtgtgtgccatactgtgacccacgggcagcccctcctcctctactgtgtcaggtggaccagggtcacctctgttctgcgcagctttgagattctaggattctacggccggcacgaatggcatgggagggttctctgcacgggacggcataacggcatgccatccttcaggctggcaggagcctgcgcaggtgtggcaaaatcttgaaacagcctgtgtcctgcctggcttttcactttcctatttaatataagaaagcacttttttttctgctttacctacaaatgggttgaaaatggcctcctctgtcctctcctctcttttatacactctgtaaaatcacaaaggtgcttcaacaccgactgtcatgcagtgctgttttgtgaattggcagtttctgtataaactcttatttatataanaaaaaaaaaaannnnnnnnnnnnnnnnnnnnnnnnnanncccccccccnnaaaaatnttgggggggntttttccgnnancccnaactnnaaaaaaccnttgggnnnntnggcnccnccncccnnnaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 1579 - DNA, 1039 bp, Homo sapiens
  misc_feature (1)...(1039): n = A,T,C or G
ccagccanaanacngnganaaaaggncngacgnanacagannncgannncgacgccngnngaanaagcananancacccccccaggcgttggaacccttcanagncgacgaaggcagacccacgancgaaccggcacgagactgannagancnggcncgaaaaagtgtgngccatactgagacccacgggcagccncnccgccnctacagngncaggnggaccagggacaccncnggacngcgcannacngagaannaaggaancnanggccggcacgaagggcaagggagggannnctgcacgggacggcanaacngcaagccagcctncaagcnggcaaganccagccaggnggcggcaaaaacaagaaacagcccgaggcncagcccggcncncaaccaggcccnaancaagaaaaganaagcaccngngcnggacggcngnacccacacaacgggcacgnaaaaagggcngcccgcgnggacacngcnnnncatnggaaaccaccnccnggnaaaaancaccanaagggggccngcanaaaacccgaacngggancaagngccanncagnncgggnaaanaggangnaaaaacnggccagnnngcnaccgnggaaaaaaaaaacgncnccnnnatngncgcnncnncnnncacggcaananaccanagcgggacagacanngancgcanacanangcgancggagaananggaaagaagggagacaaaacagcanganngacgaananggnacacgcnacacgcacagcgangnngnancaaaagnanncncngcannannagngngnangcaaaanaacgcgangagannaganagnggacgcacnngcncacnaganggcgnncngacgnnnccccaaaacgacnnacgnnnnggagcaganaacgacgcacnanaaaggacgnanganncannnccgngaanaaaggnagaaanngnngnacnanggcgacnccaggagacaacanangnnaaagcnaagccccnagnacaaaagcaccaaaanaancnccg

SEQ ID NO: 1580 - DNA, 759 bp, Homo sapiens
  misc_feature (1)...(759): n = A,T,C or G
gcnntttgatntncatacanctacttgttctttttgcaggatcccatcgattcgaattcggcacgagctgccttccaacaaaatcgtcaagcgggcagaggagttggtggggcaggagttgccttattcgctgaccagtgacaactgcgagcacttcgtgaaccatctgcgctatggcgtctcccgcagtgaccaggtgcatcttcagcctgcatccccttcccaggagccaggccactccctcagctgccagaggctgggtccctgctggggccagggtgggatggaaatagacatgagcaagacaaaatagcagatatgaaactgttgtccttgagggtgtcacatttggggtggggacaagggtggggagataggcaagtcggcaatgtagaccagtgcagtgggttggggggtggccacagaagggagtcacagcctgaaacagccctccacagccctagaggccggctttatgattcccactttacagatggggaaactgaggctcaccgtgcttaagtaacttgtccaaattcattaaactcctagttattgagtctctagtccatgtcanccatggtgaagaacgggggagttaaacctacatgtgttctctccaagggccccgatcaaggaaagcttttgtagaaanangtcacacccgagcccacctgatttaattattttgattaatcttgaaaaaaaaatgaacctggagattaccagggaaccgggggccaataangaagtgtagct

SEQ ID NO: 1581 - DNA, 980 bp, Homo sapiens
  misc_feature (1)...(980): n = A,T,C or G
nntnntnnnntnnnnnnttntnnntnnnnnnnnnntnnnnnnnnntnnnnnnnnnnnnnnnntnnnnnnnnnnnnnnnnnncangnnnnnnnnnnntnnnntnncttntnnnnnnnnnnnnnnntnnntccccccccncccnnnncccccccccnncnnttnnnntnnnnanganntaccagtaggancgaagttatnctaccacatgaatnatnntgcggncttgtangagttggtggggcaggcagntgccttattntntgaccngngacanctgnnancacngggtnannnntntgctctntggcgnnnccccntgtgaccaggtgcatcttcagcctgcatccccttcccaggagccaggccactccctcagctgccagaggctgggtccctgctggggccagggtgggatggaaatagacatgagcaagacaaaatngcanatatgaaactgttgtccttgagggtgtcacatttgggggtggggacaagggtggggagataggcaagtcggcaatgtataccattgcagtgggttggggggtggcccacanaagnggagtcacagcctgaaacaccccctncacagcccttagaggccgggcttttatgattcccacttttacaggatggggaaactgaggcttcaccgtgcttaaanttacttgtnccaaattcctttaaactccctagtnnttgagtctcntaagtccattntcagcccatgggtgaaatagccngggggggaatttaaaaccctacnttgtgttcttttcccaaggggcccccgantcaaanggaaaggcttttggtatnaagaanggtcaccacccccgagccccagccttgattnttaaatnattttggttttaattcttgaaaanaaaantgaactngggatattaccagggaanccngngggccaaatttaatgganatgttttngccntaagggaaccancctgtnagnccnngcg

SEQ ID NO: 1582 - DNA, 1336 bp, Homo sapiens
  misc_feature (1)...(1336): n = A,T,C or G
aggnnngnnnnnnnnnngnnngnnngnnnnngngnngnngngnnnnggnnnnngngnngnggngnggngnnngnnnnnnnnngannnngngnnnnngnnnnnnnnggnnnnnnngnngnnngnnannnnagangnnnngnnngnncnnnangangggnggnngnnnnnnnnnnnnnnnnnnnnnnnnnnngnnngcngntangntgggaaaaaancccccntttttggggaagaaanannccccccnggnntnctttttttttgggccnngggggnaaancgccccaannccgggggaagggggcgggnnaanatgtgncgggggncnaaccggnaagggggaanggnganagnnnngngggannnnnngnnnggnnaggggnnnnnngnngnntttttttttntnnaanaggccnagncgangnnggggnnnnggnnggcngnnnnaagggggngggggggggggagntangggggcangnnnaggggggncantancnnangggggnngngagaacgnnaaacaacacagggncnnggaanggaggnggnnnagnnngnnngagnnacgnggcgnnnggngngnaangccnncngggggcngggngangngnanancangggnnanagnagangggaggngggaaagggnggggccggaantgnnggagnggcaagggangnnggancggagggangggggcgagaggangagccnatcgagngggggnaggggngacaggaangganaagnangggggnaaggcgngaancgaaggggggggnatgaggaggaganngngagngctggggggaagggggnanngggggggggnngnngagnnggnnagngggngggnggangangatgggagcnaancggtggacaaaacggcggcncaggnggggcaggnanaaaagggccgggagcggngcngngggggaggngcggnggtgtangaggcaggnaaattganngggagacnnggngngcgnnggagggnngaanagngnnngaannaagacggaacnaagtggaggagggggnannnggcgcaggagagngagggngtanggnagananananggnnaggacnggngncgnggngnngagtgagnggcgcganggagngngaggngagcggnganngagggnnggnacggggatggggangncngggggngnnncgcggggcgtggggacnccnggggggggggggggnnaagnnancnngggggngnannagangangggngnncgntgcnggngngggggggggagagnaangagnacgnggggggggnnacgnnggggnngagngcgagnnngcgcgg

SEQ ID NO: 1583 - DNA, 1328 bp, Homo sapiens
  misc_feature (1)...(1328): n = A,T,C or G
cttatgnnagatcttatcncnntaactngacatnnaanangnagtnnntcnctagccnattaacacattccgatntntattaaccnccnnccnncccnccccctcnnnnttccaaagntaaatcgngggagaaaatctcnttcggnccccnntgnantttgntagaganaatgtntnttgctatggttnngngggnnngnctatctttttactnggggnattttatnntnntaacacatctntgaangctatcctaccttactnnanatnatacgagnaaatcatgaccacttcnnatgacnnnaaacatagannncacnacccttctnnncgagtannnctcctagnacttattntatangtagnatnannaaattcnnaatnatttcgnacannncttttannttanntagnatnagactnattanttancgattnatntatactatannctanctnnncacntagcanacttgnnanacaggcagtacctagnctnattcngctcagcacanctntaatccaccaggaaanaannatataanncnancntgtaatatcntttttatcnctnnncactggnatcanncnncatntgattcatcatacgaatntatatttcnntcttnggcatnatatnnattcatnatannncgctctncnanacaccacatanataantatagngctatatnattaaattcncaatctggnacnnacnaanttaanaancanctanctacacacacaatcanaattcacataatgacntantntcntnacanatanatanctaatntagaaagnnttattctgnntancccncncttaatntngcnntctcgnttntgnatnncgataanannaacnnnatnttatntntacanaaaatagnacatatggcnctacatctacgtatgcgcatacacngncttatgaanntncncacgtgnacgagacntactancacangtaananntcttcncnantnagngctantntcacatnacacnntctaganntaactnattncacagancatacntcttatcannatnttaatataacgnacnncncattcatcacatcananctaacanagantgtganatatanactanctaagttnattaaaacatagttacatntnnatatnantctnancntatatcgnctcctatnttancttcnctcnatntgcaantgtatcaatactcatnactanagnattctntctctatattttaattttcntntnntatannttacntantcntcacaccctatactaagatttnatnanantctnatctanccactanatnnn

SEQ ID NO: 1584 - DNA, 740 bp, Homo sapiens
  misc_feature (1)...(740): n = A,T,C or G
caccccatcgtgtacttaactgtgcgtgacgtgtgcttttggtangcatcactgtgcccaagtatttcatgtncattgtaaagaggaaaaatacagatttctctataatgtnaccacttatttctaattgccacttttcatcttgtggaaatgccatgttctgattcantcttctgaatttgaacattattcaggttatttccaattgctgggaatatccttactgctaaaataaanccttagcattggaattgctaggncaaagattatgcatgctttttaagggcttttgaaatgtattgccagtctgtggcctgccaccctccctgaacatgcctggtcttgcttaaaatgtattgccagatantccttgggaagttcatgttgtctttaacaatgtgaaatagtacnnctattcacnttccttttgtctgacaattnngataagtnaataattgtntcccaccattntgtagtannggtttttaacntggaaatccnaatcaatacctgggctgaagcatcagtgnttccaccctacctanccaaaaaaaggattcnagggtattccnncaatcagtacctgccctaatatattanagcccttacngganatnaatcanaanangcttttaaaaacaaanaancccnggacnnggccnttttacnnaaatgcccccngcccntntnaaaaagnnactnggnttttaangnnatngaaaatggcctttgggcncgtt

SEQ ID NO: 1585 - DNA, 1003 bp, Homo sapiens
  misc_feature (1)...(1003): n = A,T,C or G
tttttttgaaacctttnnnnntngaataccnanacaaactctgnntgtctnngcgggatcccntcaagtccnatncggcncgagcncanctttntnnanntgtcgcgtctgagcccatgagncacgacnncnttcnccggcgcctgnattgncatntctcccaaatacgtggctnntccncantnngaatnatcgnnatttttagtgccagannattggcnataatgtncnccntgaganaaannctnctgncatgngaaaccatcttnatacttgncgtnncnaaatncattgtganntntgaaggggaacgggcnctnnnaaagngatgaatttcnnataacttnacnggttnatnangaatgattttgcncacanccggaaaatcaccccactnntttgnttcaagantgggcccctaacgggaggggtantagaggcaaaccntctttgcgggctnttntatttcctttnttcaaacaccaatntttgntgaanaataacagtgttttnaattnaattaccaccgcntncantgngattntttgncccattncaaaggntgggtcaattcccctaaaanaattgggaaaanantaatttnccatttcntttttccnttnaaangaaaccntnccntgnanttaaaaaaanattctntntnnttccncaaattttttnnttttnaaaccnctnancggctaaccaggnccgnttttcggtgnccctntttattgttggccanntaaanccccnttttaaaaaaattggccttnaaaaaatccttaccatttttnnnaancctaaaaanggattaaactttcaaanccgtnaantaaatttnngggggttcatntnnctttgaactccccctgcntcccntanaattngaattgncacattggtngnanccaaantatggatntttcaagannaanactgggcttncaaatgncttttttcancnaatnanntnatattgccattttgnggccccccccnt

SEQ ID NO: 1586 - DNA, 740 bp, Homo sapiens
  misc_feature (1)...(740): n = A,T,C or G
actttcnaatcgcacgagagacantctcctgcacacgnccctgtgggaaaagccagcttctgtttgcactggtcttnacaactcgttacctggatctttttacttnntttatttcattgtataacacatctatgaaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagatcctctggaccttctccatctacctggagtccgtggctatccttccgcagctgtttatgatcagcaagactggggaggccgagaccatcaccacccactacctgttcttcctgggcctctatcgtgctttgnaatcttgtcaactggatctggcgcttctacttttgaggggcttctttgacctcatttgcttggtggtggcccggcgtagtccanaccattctatactgngacttttttctacttgnacattacaaaaagtacctcaagggaaagaaagctcaatttgccaaccataagtgcccaaaacccatcacccacatctgttccttnnagggtgcttcggacagaattcttacacagcaaaaggcataaagangcttganccggaaaataanaaacttaactcttttgttccnaaaagncatcaanggctcctttan

SEQ ID NO: 1587 - DNA, 651 bp, Homo sapiens
  misc_feature (1)...(651): n = A,T,C or G
ntgacattgtgattgcaaaaagcccaagtgatccacantcaaangtntgactgnganannaactggnnatgagncaatgaacttnttgaagacatcactcctctaataaatgtggatgaaaatgtggcagaattggttggtatactcaaagaacctcacttccagtcactgttggaggcccatgatattgtggcatcaaagtgttatgattcacctccatcaagcccagaaatgaataattcttctatcaataatcagttattaccagtagatgccattcgtattcttggtattcacaaaagagctggggaaccactgggtgtgacatttagggttgaaaataatgatctggtaattgcccgaatcctccatgggggaatgatagatcgacaaggtctacttcatgtgggagatataattaaagaagtcaatggccatgaggttggaaataatccaaaggaattacaagaattactgaaaaatattagtggaagtgtcaccctaaaaatcttaccaagttatagagataccattactcctcaacaggtatttgtgaagtgtcatttttgattataatccatcaatgacaacctaataccttgcaaagaagcaggattgaagtttccaaggagagattcttcagaatgtaaa

SEQ ID NO: 1588 - DNA, 820 bp, Homo sapiens
  misc_feature (1)...(820): n = A,T,C or G
ccaaactagaagctgtcagtgacaataacttggaattagtcaatgaaattcttgaagacatcactcctctaataaatgtggatgaaaatgtggcagaattggttggtatactcaaagaacctcacttccagtcactgttggaggcccatgatattgtggcatcaaagtgttatgattcacctccatcaagcccagaaatgaataattcttctatcaataatcagttattaccagtagatgccattcgtattcttggtattcacaaaagagctggggaaccactgggtgtgacatttagggttgaaaataatgatctggtaattgcccgaatcctccatgggggaatgatagatcgacaaggtctacttcatgtgggagatataattaaagaagtcaatggccatgaggttggaaataatccaaaggaattacaagaattactgaaaaatattagtggaagtgtcaccctaaaaatcttaccaagttatagagatccattactcctcacaggtatttgtgaagtgtcattttgattatnatccatacaatggccacctaatccttgcaaagaagcaggattgnagttttncaaaaggagagatcttcanattgtaaaatagagaagatnccaaatgggnggcaggcttncccatgttaaaaaaagganggaaaccnctggtcttcnttncaagccaattnctgggaanaaaaaaaaaanggcttttgttaaaanaaactggggacaattcaaggancctttttgggggactntaagttgccaaaaaaaaaaaaaaaaaaactcggnccttttaaactntng

SEQ ID NO: 1589 - DNA, 690 bp, Homo sapiens
  misc_feature (1)...(690): n = A,T,C or G
gtatcaatcgcngtaacctgttcccttgatcntgagttttagctcagataaccaggtattttgaagacgtgattgtccttggccctgccccatcccttccctttaaagttttaaatttttttcatgtcttttctttggccagaatttctctatcccctgcatgccttcctcggttaccataaatctgcattatcctaggaaagatgaagcccacagattgtacgatttcagagtacttcctgggcccctgtgtgatccgacagaggcctggtcatcaagttggacttccctatgtgaaaccataaactaacctgaggaagatactgaggggagaggggctgtgtaacggtgactgcctctaggccagccttctgccaggcagagaacaggaagctggcatgcagggtgtctggcactggtaaaatgacaccatgtttgtaagtgcattgtcctggcttttggtgggccgtgcaggagttcctgcctgaattatagtctttccatctcatatcttcatgtggagccctcaagctttaaacaaagtctttttatctccggttttcaagggtgggctcccattatctttgagaacctcataatgctgcttttcctttaaatttngttttacacttgnccgctnggtcagcacaagagctacttcacattttntggncccccacntcggnttca

SEQ ID NO: 1590 - DNA, 727 bp, Homo sapiens
  misc_feature (1)...(727): n = A,T,C or G
acnttcaatcggcacgaggctngttctggngaaagctcantaagtatggattttattcctcaactagtaggataccaatactggtattgaaacttggggaaaataactggagataccagtgcagctatttaaagctgtagcaagggctgcaatcttgcggagattttaaagagaagttttaaagtttctaatactgatgcctctttttggtaaatacaagttttataaatcctgccctgggatcctgattccccattaatcaagatttgtcagacttcaccttctataattagaaaacacagttataagaacagtcaattttttaaattttccaaattaaaaaattgcaccatgattttgaacaagcacttccaattacattacccatcttgtatgccataggtgggagtataattgtcacagcctttaggaatgtagttttccgggatttattgaaactttgaaccttttggcctactaagttcattcctaggaaactgcctaatgggaatgatctgacaagtgtacacaagcaaagtcattgcacctttggtctttaatacttaaaactaacccaaatgcccttgcagtaagggactggtttaataaatggtancctttatgccaatttgttctaaagtattcgtttaagagangtggaggaatctcttggattattagggcaagaattctaacttnggtaaaaaaaaagtggtgcaagcatttt

SEQ ID NO: 1591 - DNA, 460 bp, Homo sapiens
  misc_feature (1)...(460): n = A,T,C or G
ttcnaccagctcttgttctttttgcaggatccctcgattcgaattcggcacgaggcttgttctggggaaagctcatataagtatggattttattcctcaactagtaggataccaatactggtattgaaacttggggaaaataactggagataccagtgcagctatttaaagctgtagcaagggctgcaatcttgcggagattttaaagagaagttttaaagtttctaatactgatgcctctttttggtaaatacaagttttataaatcctgccctgggatcctgattccccattaatcaagatttgtcagacttcaccttctataattagaaaacacagttataagaacagtcaattttttaaattttccaaattaaaaaattgcaccatgattttgaacaagcacttccaattacattacccatcttgtatgccataggtgggagtataattgtcacag

SEQ ID NO: 1592 - DNA, 516 bp, Homo sapiens
  misc_feature (1)...(516): n = A,T,C or G
ttcatttannctntttttttgcaggatccctcgattcggaagagcttctgcaggggctgagcagaccccagggcctcttagccaatccccgggcctggtgaagcaggcgaancatatggtcggaggccngcaactacctgnacttgccgncaagagtgggcaatcttttntgtctctcgggaangncccaannctcctcccccaanttgananaaaaagnaagttntggtnaacccancntaagccataagttcccctggggcccctgggganaaagncttcaatcacngggccaagggcttctggnccccattnattgncttggacaagaactctgggtcacaagtcttgctnggtcttgctggggaancccnaccngacattgggccncagacttgctggtcttnttgggaagaagggcaagaccccaaaccaagatccaaaatacacttncagctcttaaccaaggcttnctttcaagtcacaagttgttgccngaaatcagtaacaagaagt

SEQ ID NO: 1593 - DNA, 1207 bp, Homo sapiens
  misc_feature (1)...(1207): n = A,T,C or G
agattntcgaatcgcacgacttgnccctgtggggtcttacncgatgtgtctctgagtagtaaaggcttagccttgttcctgttatgttgcaagaaggaggggaaggttcngngatttcttctgatttattctnnggntccatgtganccggccntcacgtgnanccnncngcacngnacgctcctnncgnatccacatacnccagntanacntnctnnnnanccaccacncccanctgcnantccanntcncccaacgcncangcntnagcctntannccccccaccctcncnnagncctactacaccnccattnnanccnnccccnaanatcaccccctttcctaccatcgtcnnancacnncccatctacantcnncnannaccgnntnnnccnccagtnatcanttcactcntacccncacgcctncanngnncnaactctnccctgccaatcatgttctanngcannncncnnctcntancctactcatcntattaaacttntctctttncnctntgcnacatnanactcctcttnngnctnnctcatnatccgcnctacactcaacattctgncnnnatnctatnngnaccntaaaataccntcacataatcntgacgcacatcnntcnctacnaatcnattgtcatnntnatctccncctctntaccatantctctcntaacagtnatntctcattctcaaacttcgccatnncccacnantntctcttacgcacacnntcctaanccctatncataccattnaatnncctgccttgctatgananncnncgancacntacacannntgtancnaactanatacaantatcgctccctctcactaacnnctnnncntaatanaacataagccnnnctancgnntcntnntnacaaccacatntactcttacgcactgnnntctctctttnggnntcctctttcgcaacgnctcannantccacacgntccttacgcccatcatcctnnccctacagtatgtaatcccntanattnntncanatattcatcnccangcccgctactgataccttcnctgctaccatcnctccccctatanttncgtctcgnaccaatctacgtntacacngttncananccaataancnacctcatgctncgnacatacganacanatgcncatnatccacattnccctnccncanacatntntctaanccc

SEQ ID NO: 1594 - DNA, 466 bp, Homo sapiens
  misc_feature (1)...(466): n = A,T,C or G
tntacgttcaagctcttgctctttttgcaggatcccatcgattcgatgcgcttattaggtattttatctttcaaaaatatatgtncccaactgtgtttgtttgtttcctgactgtgaacactgaagaggactagatcaaaaatgaccaattgagtagcaattgaacatttacagtgctgtgtgcagtgaacttctgtagcacccaaattgtggggttggggaaaaaccattccaccttaaaagaaaaccaagcctttctggcaaaattgctgattctaggttttggccaagaaatgtacatgctgactggaacattgcataacagttagtaaggaggctgttaaagactatttagggtcatttcagaaagactggagaaatgactgtagaattcccactggcccagagatcnggtagaaacctgtgaagtgtgtttaaattcttgagttcataatgggtattttaa

SEQ ID NO: 1595 - DNA, 723 bp, Homo sapiens
  misc_feature (1)...(723): n = A,T,C or G
aggttttcgattcgcacgatatntntcacatgttaanaanatatgtacccaactgtgtttgnttgtttcctgactgngaacactgaagaggactagatcaaaaatgaccaattgagtagcaattgaacatttacagtgctgtgtgcagtgaacttctgtagcacccaaattgtggtgttgggaaaaaccattccaccttaaaagaaaccaagcctttctggcaaaattgctgattctaggttttgggcaagaaatgtacatgctgagctggaacattgtcataacagttagtaaggaggctgttaaagactatttagggtcatttcagaaagactggagaaatgactgtagaattcccactggccagagatcggtagaaacctgtgaagtgtgtttaaattcttgagttcataatggtattttaaaaaggaattggttactcttagattagagcatgataggaacaaatttattaccttgaacattggtaaatacaagaaagaacaatttatcctgcttttcctatgtgagtgtacctctggctaacaaaatagtagatatgggagagctatttcaattgataaatgaaaaaagaaatggcagaattgcaataccaccattttataacttttggtgaacgaatgggtctangtggtgagcgtcgatngctactacatccccnnnnaaaaaannnnntnnnnnnnnttnnnanangaannnnct

SEQ ID NO: 1596 - DNA, 464 bp, Homo sapiens
  misc_feature (1)...(464): n = A,T,C or G
cttnnttagatacagctacttgttctttttgcaggatcccatcgattcgaattcggcacgaggattcatcttcttgttctttaaaagtcaaaaggctttttgacctttaaataactcttacatctggtcatcactgttgaaatgttctactaaattttcagagtggaaaagttttaggcttaaaactgactggtaaaaatagaatatttctttgtattgatttttcagtatagctgtacagccagttatccttcgttaagtgtttcggtattaaaactgctcacatttgtaaatattgagcagctttattgtcagaacaagaatcccttggtttcccaatccccaacttttaacattgtaattaaacatcctgtataacctattttattctctgccaaacaattttatgactgctgtttttactctttgtgatgaaaatgggatggagaagataaggttctttg

SEQ ID NO: 1597 - DNA, 709 bp, Homo sapiens
  misc_feature (1)...(709): n = A,T,C or G
atgtngaccanttcngcacgaggattaatcntcttgttctttaaaagtcaaaaggctttttgacctttaaataactcttacatctggtcatcactgttgaaatgttctactaaattttcagagtggaaaagttttaggcttaaaactgactggtaaaaatagaatatttctttgtattgatttttcagtatagctgtacagccagttatccttcgttaagtgtttcggtattaaaactgctcacatttgtaaatattgagcagctttattgtcagaacaagaatcccttggtttcccaatccccaacttttaacattgtaattaaacatcctgtataacctattttattctctgccaaacaattttatgactgctgtttttactctttgtgatgaaaatgggatggagaagataaggttctttgccttatggtggtatttattatcatcctccatcaatgcagattgggtaaatagagaaaaattcangccgggtgtggttgtgcacatctgtagtcccagctgcttgggangctgangcangagaatcgcttgaacccaggagtcagaagttgcagtgagctganattgcccactgcactccagctgagcacanggtgaaactctgctcaaaaaaaaaaaaaaacccttnaaactatggggngcntttccgaaaccnaactganaaaaactttgtgagttgccnccct

SEQ ID NO: 1598 - DNA, 1372 bp, Homo sapiens
  misc_feature (1)...(1372): n = A,T,C or G
nacntantannttnatantnnttctntnatntccnntncntncntctcnttgnntnnggtnnntnntntttnttcngtttncccccccccnnntnccccctttntnttttttcttttgnnnccgtagaccgngtgaaatgattngctgngccncccggtatgttattttnntatatgnttncnatncatnantttttctatgngncnncacttttctaccntntngggggtgttttttanctccattannnattctattntnnnacttcttgattantatnangtctttntcttttnncccatcntntntcttnnncactgtnnanctnttnntccctnnttnttatcttnnntttcntnttacntaaattctctcnntcnttatttntntcttcatctntntngcnttccatttntttnttttntcctttncnnnctnnnnttcttttactcttnccntctnctcntncncctnctncanntcattttttcttanctatacgcgttattaagnnnnctactncgtnctnnatatnttnntactatcnnnntcncttttgntnnagtntantccctnnngtatttctcntnnngtctatntgctntattatttnntntctgtntntcttctactcncnatatcatnnacnatacntatatatatatacancttgtttctatntntanctacataatgttcntttantcttntttnttctnctagtatgttncttnattatctanttcntntttatntatnctatcttctnatnattntntcatacctntattcgtatatanagnaactcnacatgntangtgtccnttncnatctcannnnttantctttncattcttnngttatctgncgtnttncntntnacntgatantcatatnnccntnancntatatgatgaatcacgntgtctttntcaagctnnnntctctctttccttctntnnataaacttntgactcngtagtttacttgatcttttcnatntctnaacatcactccattcncttncgtcnngnacnnctctnttctntactattcttntctactcctctnctctnttngttanttacncctccgatnctnttanttctcacnntncnnattttctaatgtantntntggtatatttctgntatctctacanccgatcnnanctacgttcgtatagtatnctaatanttgatntnatctantgttnttttatcctncnttcntantnctntttacatnactctntttntctgttttctttatctnctatngtnaantttcctatgngtatnatncngttnctctctannatttcatcttctatctntanntctcattgtatgcttctttngcttcttcncn

SEQ ID NO: 1599 - DNA, 464 bp, Homo sapiens
  misc_feature (1)...(464): n = A,T,C or G
tngatnccttcgatcagctcttgttctttttgcaggatccctcgatncggcctatcttagagaatcatctgctcannccttattcctgcagaatacaaatgtcacattctaacctgttcagagattgtcttcaanataaaantgtgattcctacatggnatgnnaaacaanctacactnntnggcaaaaggcattattagggntngattccataatgattgagtnctnttnnnnagtatantcatgcanctgaacaaaatgaagctcattccactgcntngaanaatnncacaaatgtgatgctnaananaggaagccacgtgcanacactnactatataattntatgtacatnaagttcagnatccggatagttaccnntgnnaaggangtaactnnangagtntgaggaggggnttctggtatctggttaatgnacttngtaccanttacccaanagtgnnt

SEQ ID NO: 1600 - DNA, 922 bp, Homo sapiens
  misc_feature (1)...(922): n = A,T,C or G
nnncnntacncntnnnnnnnnncnnnnnnnnnntnntnnnnnnnntnnntntnntnnnnnnnntgnnttntnnnnnnatnggtnnnannttntnntntnnnattacntnnnnnnncnntnccccccacgnnnnnnnnccccccntcnntnttnntnntnnttnaatntcgantccgcacggaggatatactacttatggnacantgagggtgcaanggnntcctannattcatgnggatgntccnnggtgtgaggagggaatctgcaattgnttgctnnacagagcgctggcaacttctgacaggctgtttctggggtatgggctgcctcgggttgttgctgttacaaggaaagaaaagagttcccctgcccaccgcctcccagccactgggctacctcctggcaggaaatttgcaaactgagtttaacaagttaggatcagcagagggtagaggagggccctggcagatgtggggtctagaagaggacaggagttatcagggcctccggccattgtgctgggcctttgcctgtacaattgtttctcaagcagttgtgtccctgtggctttggtgcgcctgtgtgcactttctccctccaccttggagcatgggctaacacccggaggaaaaggaaaagacagagtcaagacaggggacaatgaaacctttgaagtgcccantctatgaaagaggcccgggggtgggactaagaatccantgccgcncccaagagtttgaccaaccacccccctacagcaactnttgnggatccccccatcacctgagggaggaaccaacctacccattccaaaaggggtccaagggataagcccaaacctggggaacanaagcgaaanggcctccaaaggggggtccattnggccccaggaagggaancccttgggaaaaaactcccannt

SEQ ID NO: 1601 - DNA, 864 bp, Homo sapiens
  misc_feature (1)...(864): n = A,T,C or G
ttgaattccatacaagctacttgttctttttgcaggatccctcgattcgaattcggcacgaggagggaggatcccctgggttgtgcatatggcgggaaggggtattccaggagtggaggatgtcagcagggtgggaatgggatcagtgaggggaggaggagcagaggagtcagaaggatctaagggtagggctgaaggtgggaaaacacctgtagggctgtttaggacacggaaagggccttgactttgctgccaacnaagatgtgaagctccaggcaagggtaacaatctaacttacattttatgagggtcctgtggcagctgtggtgagaacagactttaagggtgctgaggtggatcacggagacctgtggccaggctcttgtgtggtaaatctggtttgggagaatggtggagaactggatgcangtaggancactggaagtggcaagaaatgactggattcttgaatattttgttcaaaagttgganccgaaccccggttttgtttgatggaccttgaattgttggggtgttgattaagaaaagaagaaggangttcaaaggaccaattttcttgnaaggnatctttaanntccnggaagccaanccttggnaaaaccaaggaaaggncttgccttgttnnaaattggnaaaaaatngggaaattgggaaaacccttggggtttttttggggttngggggggnattttttcaaacccccatttggggatttnccccatttccanttttttggangggnnngttttttcnatttcaaanccaatttccccttaaantgggggtnggnaattaatttggggaaccttggggggccccaaatttttngggaacctttttacc

SEQ ID NO: 1602 - DNA, 619 bp, Homo sapiens
  misc_feature (1)...(619): n = A,T,C or G
ttgattcnatacaactacttgttctttttgcaggatccctcgattcgaattcggcacgagaagagacagcctctctcttctgtctcagaagctctgtgtttgggaaactttgagcccatggagtagcagggtctgcatggtggagtaccaggtttccctggcaatccaggtctcctntgaggaagcattctgacttcccactgaccacggaaggcatgtcagcttcntgcctcggnctagagttctgataatcggggctgaggggtgaaaagaaatccagtcagacagacagtgggggagacaggtccctgccctttatttgccgggatcaatcagggactcccanaaaggaaggagaatggtgagaaggccctaagagttcgtctctcacctggggctgtgacgtggcaccacaactgaaacagctatgggtggcggtgtgtgttaacctcacgtnctgaactgacattgncaaagaggaggagtntacattcagatggcaggcgttcaggaacaacacattattaatggctagcagtgacatatgagaaacagatcttatatctccaggtagcacccanctgttgttntcatatcttgagaganaatggatannact

SEQ ID NO: 1603 - DNA, 721 bp, Homo sapiens
  misc_feature (1)...(721): n = A,T,C or G
ttgaannccatacaactacttgtctttttgcaggatcttntagacctttgtgaaccagatgatgaaagtggctatgatgttttagccaaccccccaggaccagaaagaccaggatgntgatgacgatgcctntagcggatgtgtttgaatttganttttcagagacccccctnttaccgtgttataacatccaagtntctgtggctcaggggccacgaaactggctactgctttcggatgtccttaagaaattgaaaatgtcctcccgcatatttcgctgcaattttccaaacgtggaaattgtcaccattgcagaggcagaattttatcggcaggtttctgcaagtctcttgttctcttgctccaaagacctgggaagccttcaaccctgaaagtaaggagctgttagatctggtggaattcacgaacgaaaattcagactctgctgggctcctctgtagaagtgggcttccaccccagtgatctggcctcagacaactactggtgagcaagctggcccaccatgtacagtgtggtatagtggttaatccttgtgcatatgtgcataatacaactattctgnnaagaaaggcactntacatatgaaaatatttnttntttatataagaaaaattactccagtcagaaaggacttaaaaacatgtttttttcctttttaaacttttaaagtcaagtttttatgaaagtgggttttaatngt

SEQ ID NO: 1604 - DNA, 738 bp, Homo sapiens
  misc_feature (1)...(738): n = A,T,C or G
ttngatacagctcttgtcttttgcaggatcttatcgattcgaattcggcacgagccctatcttatgagaaaagtaactttgaaaggactaatacatcctgttcttagcttntgcttccttcaggccttctctatgaagccagcctattctgctcagcgctttggaacactgattctatttcatggaccgaagcattgcccaattgtagaattgcaataaagccaactgagatctttaaattggctataattcatcctttggcaatacagtaaaaaaaaaaaattctcacaattctgtagaagggtatgagatatacaataaaagacacccccaccctctgcaatctaccactcacagtagtttatctggtggtttccactttttaacaatggtctgggccaggtgcagtgactcactcccgtaatcctagcactttggaaggtcgaggcgggcaggttgcctgagctcaggagttcaagaccaacctgggcaacacagtgaaacccctgtctctactaaaatacagaagaaaattagccgggtgtggcggcatgcgcctggtagtcccaacttactcgtttggctgaggcaagganaaattgcttggaacccatgaaggcaaaaggntggcagtggagcccgagaatcattgccggnttgcacttccaaccctgggggtggacaagaaaccgaagaacttttgtcttttaaaaaaaatttaaattaaaaaaaaaaaaa

SEQ ID NO: 1605 - DNA, 715 bp, Homo sapiens
  misc_feature (1)...(715): n = A,T,C or G
naattccatacanctacttgttctttttgcaggatcccatcgattcgaattcggcacgagagaaggtcgcctctaccttgcccagaacacaaaggtgctgcagatgctggagggaaggctgaaggaggaggacaaggntttcatcaccaggganaatgttnttggggccctgcanaagttcagtctcaggcgcccgctgcagacagcgatgattcaagacggcctcatcttctggctggttgatgttctgaaggaccctgactgcctgtctgactacacgctggagtactcggtggctttgctcatgaacctctgcctccgcagcacagggaagaacatgtgtgccaaggtgggcaggcctcgtgctcaaagtcctttcggatcttcttggccatgaaaaccatgagatacagcccgtattgtgaatggagctcttgtacagcatcctttctgttccatcctttctggaggaagcaagancaatgggaatggaagacatcctacctgcttcatcaaanangcaatgctgaaatgaccgccagatagaattcatcatcaagcagcttaaattccgaagagctaccagatggtgttctttgaatcttgntgatgatgaagatgaagatgntgaagaggaccatgacntcntggaagccgatcttggcaaaaaccaactgatnccaccccacttggaaaactctcaggaaanaagctt

SEQ ID NO: 1606 - DNA, 682 bp, Homo sapiens
  misc_feature (1)...(682): n = A,T,C or G
tnnattcnatcaacctacttgttctttttgcaggatcccatcgattcgaattcggcacgagggtgggtggcagagggaaatccaacatgcagactgtggcagtgtcttgaacttctgtttattcaggtcattgantaaaaaactcttttcttctgcattcctgtctttctgcatgtgtgtgtgtgtgtgggctgggtagggactgtttttgagatcactggctgaaatgtattctaggggtgaaggatctaggatgtacctgctcgtcatttcctgacttcacctttaccaattcttttcttaacaaatttaaaattggtcagagcaggagctgctagctggcttttaacagtgtttctcataatggcagtactcagcaaatagtttttctcttgtctcctaaaattaagttgcaagactaatgtaacaaacagtaaaatttaagctaaagaactcagtataggctgggtgtggtggtttacgtctataattccacactttgggangctgaggtggaaggattgcttgagcccaggagtttgagaccacctgggcaacgtagggagaccctgctctacaaattaaaaccgcaacacaccaaaaacctctactggcacggagtggtgcgccctgtgtccctactccaactctcanaggcagnangacatcctgggcccaagag

SEQ ID NO: 1607 - DNA, 1356 bp, Homo sapiens
  misc_feature (1)...(1356): n = A,T,C or G
cncncgncgaannactntgntanatgtaagaaataatgatnctnngcntnatancnanntnnncaaaacnattagntnnntaatanagantncnnnggnnannatnagcnaggcttgtaaccttggcaanccgtnggtcagtccagnnagtcacgnnnnncnncnngnnnttactctatcncntatntncnctngnatnttttnacnngcnggaanaatcnaccncctcnnggtggngaantagngggnnaagtnnctgnaacnataaccatggngntgagngcnagaaaancgaggagagatgnggagatgcggcacctntgtnnaaancctgcnncnntgngannnccnntggngnntcgggagnancnnactcctannnngangacnggnnnatngaatngttanncgnanaaacanccgtgactaaatgtgtcgtgggaagannnggnngtcgnntaaaangnttgatancgnttnngancatntggatttgagtaatangaaangancnncgggtngnatttnagngaanggancgggcgnnanccnnccancncgantgaagnncgncaannccncancnaactggnnntcnntanaantgntgantgcctntanannntnaggggcggggaatacnatcctaaatcgtggnancatacactgaggnaatntnnannanaagaatnnctcnnacatntnnatagananaagantatntnnagtntctnnaanacncanaanntccnttgtncaaagngaaatggncnngagngtccagcacaganataaacacatggacatccntgangcttgnatcnaacacgngacgaaagcagtngccgannanattnntntnagcangaagancnatatgctgtnnatctcncttgncnaaanctgtanttancataanaccangcncgtnngcancgangangcaatanccncantgntnagntaangctnccncattnggnggangaataaaatcngatggganantgaaannnanggngctgcncttattacgcnaatcatatctaaatatannanaccatncttgtnagangntatacnctnatantntctntcagatgngnacgcttgnatgtcntctatcntnnctattcatatctgacacgtncgnacgcatgtnnattgntaacgcacgtagngtgtncacntnncnnctcccgngnntagngacagagacnggagannncatctctngtgcgcgnatannagtaaaganccnnnctgtcanancgcgntatcgatanttatgnngtncttcatncnnntaacaaaagcaacgctcntnttnttncggaanaaaaaaanaccnnncng

SEQ ID NO: 1608 - DNA, 1588 bp, Homo sapiens
  misc_feature (1)...(1588): n = A,T,C or G
cccnncnnanccnntnnnancnngncgntatatggcnnnnanncttggtatttctccangttgancngtntnnatngtcnnancncnaatttgnnngnnttacnantccgcantgtccnntntcnattaaancngtaaagaaantncngcccnnctgtnngatngtatcggcagtattgtnantgcgnaatnnnacnnacannnantatatctgggggggcnnctnnnncntnangncncatggncnanatgcgtcnntantgtgngntngccccgtntgnntctcatgnnnctnnnnnaatncnncnaccncctcgancnnnataacnntnnnctcnngncntagantacnngaaagcgctctatcnacatccntaggctanagtcancccncnnnnttctntnntnatngaanntncnncntntnntntanaaacgatnctncanatangacnctccnctngnntaaatgantattnncntcgcaannatccaccatatnacgtngctcaanagnngttncttnatactacannnaccnnattgncggtnnnnacntcacacgctgaaagtgnggacnnacacgntctanctntgngagtantntacaccntaanatgtgatctntcaacncgcatctgtacatcgcgncgannancacnnanngatcncatnaatncgtnacancttanantcnanatnatnnntcgcncacaggntcnancctggattnnatnagnnnatgtntatnntcactannatntggcnccnnnganggcgcgacnancntngantangagngntatctgtgganncatanatcntngccacnaggtacgcnnccacntnaccgcgcngatnaagangagtttnacnattacattanagtgngtacgctttncatanaactntaannatcnagtataacnagancgnataatctntttgatnnnntctacncncgcatgcaactcnncntnntatacncnctgcgntcnacntcnngantgcanancngnatgtnnnnatcnnancacgacatgtatctacgnaggnatntttatntntgactattcnntntancgnncgactgtgtnnttanntnngcaattgtgcncattgancgtaaaatatntacgactcgttcgcgtatacnncgactcgttcncngcatttactangcantttccnctcgctaaanatccnngcctnnangagtgtacntcgtctcgagtcgcgncnntacncgnactgtgngngantnananctnctntntatncgnncgcnatcgcgcncgcatatgaccnnanntctcgcaagtatcttccatagcacntaaancntgnntctntacnatnaantnnctntacttctcanttttatacaatnnantcgntnctannctnncgcatntacgaacngcgcnnncatgantntacanncgctgncgtncngcgntannccanantgtccgctnactcacantangtncanngcttagtcnngacncacgtgntaatgntcgatcgnagcctggcgacatagncattncgtgatnanntnnncttcntcncgacgcnctnnncc

SEQ ID NO: 1609 - DNA, 736 bp, Homo sapiens
  misc_feature (1)...(736): n = A,T,C or G
ttcgatacaactcttgttctttttgcaggatccctcgattcgaattcggcacgagtgattgatgagggctgtcggccaggaactgatcgagcttgttaattgcatttgtcaaatgcagggaaattgggaattagtgaaatcggagaagggggtttggaaaacaaatgactcgtgcctaaggaaattttttgcaggaaagtatctcaggagcccctgcagtcagggagctgctggtgtggactcagactacatggttgaaataggcaggagctgggcggggcacagtggctcaggcttgtaatcccagcaccacactttgggagacggaggcaggcagatcacttgatgccaggagtttgagaccagtctggccaacatggtgaaacctgtctctactaaaaatacgaaaaattagctgggtgtggtggcaggcacctgtnatnccagctacttgggaggctgaagcanaagttgcagtgagcccgagatggtgccatttgcactccancctgngcaacaaaaagcnaaacttncatctaaaaanaaaaaggaaagaaagaaatttngcngggaccccaagcttacattctttcctttttggtaaaactggttggggaaatgggttnnccttccgtgaagaanccancaaggtagggtcnatctttncttccccccttnaggacatttggttttgccngaatctttaaaaanaaaaaatanaaacnactncttnnct

SEQ ID NO: 1610 - DNA, 710 bp, Homo sapiens
  misc_feature (1)...(710): n = A,T,C or G
canatacagctcttgttctttttgcaggatcccatcgattcgaattcggcacgagggggagtaacagaagcctggatacaattactctatcaggagatgaaaggggactttggggagactggaatgntgaaattgttttataattcttcagtagaacagatctgggatcacagttttacaggggcagagatttaagttggccctctagttatggagacactcctactggtttctataaaaggaatacttacattgcccaaaccagtgcatttcaaatcttcagcccaaggaangttccaacgctattgaatttatggaaacgtttgtatttgctattaaacttcaaaatctacaaactgtaagacttgtatttaagattcaaacccagactcccaggaagaaaaccattggagaatgctcaatgtcactcagaacccttacacacaggaaatggattactctttggatataacaccaccttcaaaaatttctgtttgccatgccagaacttgaattggggacttgttttcaagcagtaaatagcagaattcagttacaaattcttggaggcacggnacctttccaagctcatcaacacctntgaactttgagttttttcgtgaanggnggggaatgtttaacctcnggagaagttgatttatnaaaaaaaagacacgcttacttgaanggcctccatgggaanantcaaa

SEQ ID NO: 1611 - DNA, 714 bp, Homo sapiens
  misc_feature (1)...(714): n = A,T,C or G
tnnaatntcanatacanctacttgttctttttgcaggatcccatcgattcgaattcggcacgagaatggatgctcatatattgcttatggatattttggataccaaagtaggaataactggacattcagtattttaaagctggcaaacctgtacatagaaaatagatccccagacagtggtctatgaagagggcagttaagtatcaaatcttaattttcttgcctttttttcttaagtggggaaaagttctagatctcttacacctctgacacaatctgttctaaaacaggcacttgtaatgttggggcctccttgtaaacgtgtttttgccctttactctctgggattacaggcgtgagccagtgcacccggcggaatcttggaatttttatagacagcacctcagtttctgactccagccgcacaccttctgcctctaccagcangggttgccgccagaccagaccagggccaggtccctgcgtccatccccccggtaggatggacgtgagccatccttctaggggacttttttcaatgtgcgaactcgtctcttgttaggtggtangaaccagtttgtntggnctgtgccacgcctccacaatgccgtggctgggcttcttgtgtggtggnctgtggtccccttgtccctgcangaanccaacaaggcattcgtggcgtggacaacttgtgttccaaanccactggcccgg

SEQ ID NO: 1612 - DNA, 698 bp, Homo sapiens
  misc_feature (1)...(698): n = A,T,C or G
tncananttanctcttgttctttttgcaggatcccatcgattcgaattcggcacgaggtatgccccttcagaacatgcagagtgtatctttttttaaatttctccttccgtttcttaagtattgcgcagatttgttcaactttgtaaatatggacatcactttttttttctttgagaaaacacttgtatcagctttgtggtgttttcagggagacagctgtctgcattccctgtagaaacccagcaatgattatgcacgttgagacatgtgctttttatttcttagcaagatattttatctctgtacataaagtagaaaccaaaagctagggaaacagatactctttacaccatcatgccacgcattgtttttaaagcattgcgttaaaaaaaaattaactaaaccaagatgctgtgattttttaagttgcaatatgtttttggtttttttcattttttaatcattgcagttaagagaaatggaaattaagttgtgttaaatcttgcagaatgtttgcaggactgactatcaaactggatgatttccatttatccctactgngtcaggttcaagcatcaaaaatcccttgcntctgagacagacttnctancatcagggacagggatctggtgtgtcattatacaaaacagtctagggggtggaactncntagtaaaaaaataaaataaatggncctt

SEQ ID NO: 1613 - DNA, 698 bp, Homo sapiens
  misc_feature (1)...(698): n = A,T,C or G
ttnnanttcanatttgactncttgttctttttgcaggatcccatcgattcgaattcggacgagaacaacaaaaatctgaacagaaatgctctatttacgttcttttccttatctgtagtgttttaaagtcattaaacttaaaaatgatgttcaggagaagatgagtgtatttgcatagtctgtcataactctggtattattttgtacaaggagtgtgttagggttttcagttgtaaccatgcagaaaatctacaaaataaaagcagttgttaattagtcctttacaatcagaattgtctattttggaaatttatgaagtacttcagatgtaatttaagaaattgtatttgagccaagcgtggtggctcacacctgttatcccagcactttaggagcctgaggcaggtggatcacaaggtcaagagttcgagaccagcctgaccaacatggtgaaaccccatctcaactaaaaatacaaaacttaactgggccgtggtggcgcgcgcctgtaatcccactactcaggaggctgagtcaggagaattacttgaatctaggaggtggaggttgcagtgagccgagatcacgccctgcacttcacctggaaangangggaaagggaaaggaaangggaaaaggaaanggaaangggatggttttcaggctgggcacggngnttacgcctgtaatcccacact

SEQ ID NO: 1614 - DNA, 701 bp, Homo sapiens
  misc_feature (1)...(701): n = A,T,C or G
ttcntatcagctcttgttctttttgcaggatcccatcgattcgaattcggcacgaggcaacgaaataattttaaagtggatctgggttggtagtgcttatgggagttaggcaaggaaaaatgcagattctctttagaatatcttcacctaggtcccaaaggattctcatagatagatttccaacaaatatgaggttataataaaaaatacaaatcacatatagaagtatggcaccatgaatgagaaaggaaaaactgtcagaacaagaccctcaagactttactggaattaacaagcaatatgtaaagtaaatagaaataagctattcataataagaataatgtataagagactactaaaaataactgggcagatttgaaaataatctaagttctgggaatgaaaataataactgaaaaacagctganagagagaattaatgaactaaaagaaagttgtttagagattatccagaaattaggacaaatcatcataaagaaaatatgggtagaaaaggttaagatggaaggataaggcaagtgcttancatatgtccagaaggaaataatagaaaaaaatgtnttaattcctccncactggtaaaagacatgatggctcagattcagggaattgtacccatctcaaaaaaaaaaaaaaggaangaaaagtggccaggggaaatccttattaaaatccntgtg

SEQ ID NO: 1615 - DNA, 791 bp, Homo sapiens
  misc_feature (1)...(791): n = A,T,C or G
ttnanttcanattnanctcttgttctttttgcaggatcccatcgattcgaattcggcacgagatccctacctagaagagaatagatgggaagagaactgaaagaaagaattcctcaagcactgaagtcaggaaaatccccgtaggcactgtattagttgttccatttatcccagcactccacttgtggatgaaggagttgtatagaaaggagatgagaaaatggcaggagtggaagcagccaagaagagatcgatgactgaagatctccttcaccttcaggactgtctcaaggggttatttcacctctactcatgaggatggccagtttttctgtcttttatctttagacccatatataatcagttcagagcacaaatcaaaataaactggcctaaataactgaatctaggaacaaagctacatcttttttcatatgccaaagctctgtttcctcatgttgttcctacttttttaaataataaatgggcttctcaaccatcttaaggaactaagatggggtccccatctngggtagnaacccggcttntaantttttaagaaatcactcttggtaaattctttancctcactttaaaaatanttanggaaaaccnccggttnanttnggaaaaaaggaaccgggggnagaaaccttcgttcntggccagggntttttnggccaagtggaaaaantttgggtcntttncccaggnggnaaattggcctanttaantttttccaaaaatttggcccttattaggtccaaaaaaaagccttttttncccntttg

SEQ ID NO: 1616 - DNA, 741 bp, Homo sapiens
  misc_feature (1)...(741): n = A,T,C or G
ancccnttgaaattcacatacaagctacttgttctttttgcaggatcccatcgattcgaattcggcacgaggtaatcctttctttttcttctccctctttcctgctcttacttatacagttaggtgaatatgatgctccacttcccccacagatactcaaatagctctgactgctgaaatattggtatcttactgtcagcacataacttgttgctgtgttattgacattttcactgttttgaaatttttactgttatctgggtttgaatcccagctctcccaagcttcagttttctttcatttgtcaaatgagataaaagtatccacttcatagggttgttatgaggattaatgatgaatacaaaacacttaacatagtacgtggcatgtaatattagttgtaaagttaatgtattcattatcatcattctgtttcaaatcagcaatgaaatacagactacactaatcccatttctgcttggaattgtgagtctaaatgccatgtagcagttccctgcttgaaatacactgtaaaccttccaattgcagtcaagaattttactaccttctanggtataccagggatggtgggaacataagtaaaccttggagatttggcttttccccgtggtttgggaattctaanccctttctaccaaaaaaggtaggtaacccctaaaaatttctaattaccatgccccaccntggatggcctncctnccaattaaaaactttcagtaa

SEQ ID NO: 1617 - DNA, 738 bp, Homo sapiens
  misc_feature (1)...(738): n = A,T,C or G
ttnanttcanatcanctcttgttctttttgcaggatcccatcgattcgaattcggcacgagccctatcttatgagaaaagtaactttgaaaggactaatacatcctgttcttagcttctgcttccttcaggccttctctatgaagccagcctattctgctcagcgctttggaacactgattctatttcatggaccgaagcattgcccaattgtagaattgcaataaagccaactgagatctttaaattggctataattcatcctttggcaatacagtaaaaaaaaaaaattctcacaattctgtagaagggtatgagatatacaataaaagacacccccaccctctgcaatctaccactcacagtagtttatctggtggtttccactttttaacaatgggtctgggccaggtgcagtgactcactcccgtaatcctaacactttggaaggtcgaggcgggcaggttgcctgagctcangagttcaagaccaacctgggcaacacagtgaaacccctgtctctactaaaatacagaagaaattaacccgggtgtggcggcatgcgcctgtagtcccagctactcgtttgggctgangcaaggaaaaattgcttggaacccattgangcaaaaggnttgcagtggagcccaaaatcaatgccggttggnactttcaaaccttggggtggacaaaaaccgaagaacttttgtcttntttaaaaaaaaattaaatttaaaaa

SEQ ID NO: 1618 - DNA, 722 bp, Homo sapiens
  misc_feature (1)...(722): n = A,T,C or G
gnntttnannnccntttnantttcanatacanctacttgttctttttgcagggatcccatcgattcgaattcggcacgagatcatattcaagttggcaggtttgactgttcctctgcaccagacatctgtagtaatctgtatgtttttcagccgtctctagcagtatttaaaggacaaggaaccaaagaatatgaaattcatcatggaaagaagattctatatgatatacttgcctttgccaaagaaagtgtgaattctcatgttaccacgcttggacctcaaaattttcctgccaatgacaaagaaccatggcttgttgatttctttgccccctggtgtccaccatgtcgagctttactaccagagttacgaagagcatcaaatcttctttatggtcagcttaagtttggtacactagattgtacagttcatgagggactctgtaacatgtataacattcaggcttatccaacaacagtggtattcaaccagtccacattcatgagtatgaaggacatcactctgctgaacaaatcttggagttcatagangatcttatgaatccttcagtggtctcccttacacccaccaccttcaacgaactagttacacaaagaaaacacaacgaagtctggatggttgatttctattctccgtggtgtcatccttgccaagtcttaatgccaaaatggaaaagaatggcccggacattaactggact

SEQ ID NO: 1619 - DNA, 702 bp, Homo sapiens
  misc_feature (1)...(702): n = A,T,C or G
ttnanttcanattgactcttgttctttttgcaggatccctcgattcgaattcggcacgaggaactaatgaaaagtggttgtctctaaccttggtatgctttcagagcntcagggttaaattacctcaacttttggcaggtntactctaaagctattaagtatntaatatgggctcggcatggtggctcacacctgtgagccacctancactttggcagtccaaggcggacagatcacttcaggtcaggagtttgagaccagcctgtccgacgtggtgaaaccccatctctactaaaaatacaaaaaccgancgtggtgggtggcatgcacctgtggtcccactacttgggaggctgaggcagganaatcgcttgacccaggaggcggaggttgcagtgagccaagactgtgccactgcatttcagcctgggtgacagagggagactgtctcaaaaacaaaaaaacaaaaaacaatggctgggcacggtggctcacgcccgtaatcccagcactttgagangctgaggcgtgcgttatcaccttgaggtcaaatgttgaanaccagcctggtcaaacttggtgaaactgtctntaccaaaaatacaagaattaggtggacatggtgtcgggctctgtaatctcaacttatcaggangctgaggcaggaaaatggctttgaacccaaggangtggaagttcaat

SEQ ID NO: 1620 - DNA, 1028 bp, Homo sapiens
  misc_feature (1)...(1028): n = A,T,C or G
ttgatctttgattcnatcaactcttntctttgaggatccatcgttcaattcggcacgagccgcnactctgnncgccgtggtggacaacgtgcccccnttncnctgganggaattcgtncggcgcctagggntgaactngaccacgatatccgatnggcatggagctgnaagaacagggcgctgnccttgngccnagggcngcnaatacantnatgcttntcgnaacctgggaaangctggntgcaactcccnnatgggtttcggaagngnccaacggcttggggnaaaccttgccttggggaaacgtccnnttgtcttncccggatntaaccaattngggaacccccttggctttngggggncnttggcncctnnggggaannggaaccattttccnatatnnggaaanggcccccncttnttttggncggaagccccccanncccttncccntttcccctggttgcncggcccgacctccaaattgccttttttttnaaataattgcaaanggccttgaccccccccccttnantgngnccaggctttttaaaanggaacccggttcccttgntaaaaaatcnaccctttacccnaacccccaacttttnttttttnttggaaaaaaagggaaanggggatccctggccatgggngccaaantcnaagtanacttatccaaaatccggagcttnaccttttgnttggctttaaaccccaanttcggattnntaccantaaacttttttcctttnaaaactaaatccttgaccnncgnccntctcttaacaattaaaancntccttgtttncctcctccanaaaaaagnatnnttnccnccccanagnngccttcaaaaaaaaccnttgnggtgggggtngggattttngggaaggaaananaagggaacccnttttgccttnaaagccccntnttttggggttttaactgaacnaaanccaaggtttgtttngnaggccccctngggnccannccctttaanccntttttcaccaatnggcantaan

SEQ ID NO: 1621 - DNA, 749 bp, Homo sapiens
  misc_feature (1)...(749): n = A,T,C or G
ttccattcaaactncttnttanctcttggnctttatgcaggatcccatcgattcgaattcggcacgaggcggctcttttccctcgtgactcggttgctcctggcgccgcgacggggcctcacggtccgcagtcccgacgaacccctgccggtggtgcncnttccaaaaaagctcccgagacntacttttttgcacagacatagcctntcggggcctggacagcactggtgtggagctggttgtcaattatgatttccccccacgcttgcaagattacatccacagagcagggagagtggnccgtgttggggagcnaggtgccaggcaccgtcatcagttttgtgacccatccctgggatgtgagcctggttcanaagattgagctggcggctcgccgaaggagaagtcttccaggactagcatcctcggtgaaagagcctttgccccaacaacctgattttgacaaatctgattaaaatgtgatgctagacagggatctttcccagtatcttgagtggggtgaccacactttgtcagtggggaggcttntgggcttgcccttgtcngcttccttgagggccgggatgaactgcttttgtgaactttggaaaaggtacccctgcttggnccagcatttgggangaaaaaaacctgcttgaancattggcttttcttgtaagtcntttaancaaagaacacaaagtgggattttggacttttggantcatggtcattgaatttcttaacaa

SEQ ID NO: 1622 - DNA, 707 bp, Homo sapiens
  misc_feature (1)...(707): n = A,T,C or G
tttnatncntttacaactcttgttctttttgcaggatcccatcgattcgaattcggcacgagctgatcctccgcttccagaanganctgaaggagatccagtacggaatcagagcccacgagtggatgttcccggtgtgaactgcaggctgtgctccagatccaccgacccgtagcatctcgtcacgccagcactcgcctccctaccaatgactcacctgaaattgaaacgggcaggaaatagtctggcagcctctacagcagaagaaacggcaggcagtgcccagggtcgtgcccaggaggctgagcagctgctacgcggtcctctgggtgatcagtaccagacggtgaagccctagctgagcgcaaggcccaaggtgtgctggctgtacaggcaagggcagaacaactgcgggatgaggctcgggacctgttgcaagccgctcaggacaagctgcagcggctacaggaattggaaggcacctatgaggaaaatgagcgggcactggagagtaangcagcccctcgtcgcgggttcangtccgcccattactnctttgtcgtgcngtcaaaggatacacctttgcccccgattnccggatcttnttccgttctcangccanaacccctggtgcttgccggtgaattttttttttctctggctttgcttgcaatttttgaaaataaaatgnccnaaaaacaaaaaat

SEQ ID NO: 1623 - DNA, 707 bp, Homo sapiens
  misc_feature (1)...(707): n = A,T,C or G
ttnaannccnnnttgaattcatatacagctacttgttctttttgcaggatcccatcgattcgaattcggcacgaggagagagagagagagagagagagagagagagagagagagagagagagagagagagagagagagagagagagagagagctnacaccagaagaacaattagcagataaactgcggctaaagaaattacaggaagagtcagacctcgaattagcaaaggaaacttttggtgttaataatgcagtttatggaatagatgctatgaacccatcttcaagagatgactttacagagtttggaaagttactaaaagataaaattacacaatatgaaaagtcactatattatgccagttttttggaagtcttagttcgagatgtgtgtatttcatgtaaagtaattctaatttctagcccctctgggtagatttttagtaggatgttctcttcaggaggttgaaggttattttttattttcaaggatactataatacanactcatgatttgctgtttttagcaattaccttgtgaatgttgtctgcanatcagtgaatttgagtgctggatctttttgtttgttgnaggggtaagaagacttnttgtttacaatggcttcccttaaaanatacctgggcttgtcaccaaagcanttaataaaacactggcctnttntttttaaaaaaaaaaaaaaaaaaa

SEQ ID NO: 1624 - DNA, 683 bp, Homo sapiens
  misc_feature (1)...(683): n = A,T,C or G
ttganttcgttcagctcttgttctttttgcaggatcccatcgattcgctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgtttaggggctaaaggggagaactgaagtgttttactctttttctaagtgttggctttctatgnactattttcttgtgctctttttacttcntcacttggggn

SEQ ID NO: 1625 - DNA, 707 bp, Homo sapiens
  misc_feature (1)...(707): n = A,T,C or G
ttgatncnttacatttnatccttttttgcaggatcccatcgattcgtttggctctactttgcagggaatctggcatcgggtggtgccgcaggggcnacatccctgtgttttgtgtaccctcttgattttgcccgtacccgtctagcagctgatgtgggtaaagctggactgaaagggaattccgaggcctcggtgactgcctggttaagatctacaaatctgatgggattaagggcctgtccaaggctttaacgtgtctgtgcagggtattatcatctaccgagccgcctacttcggtatctatgacactgcaaagggaatgcttccggatcccaagaacactcacatcgtcatcagctggatgatcgcacagactgtcactgctgttgccgggttgacttcctatccatttgacactgttcgccgccgcatgatgatgcagtcagggcgcaaaggaactgacatcatgtacacaggcacccttgactgctggcggaagattgctcgtgatgaangangcaaacttttttcaagggtgcatggtccaatgttctcanaagcatgggtggngcttttgngcttgtcttgnattgatgaaatcaagaagttcaccntaagtttatttcctangattttttccccctgtgaaacaaggcattgttggaanttaatatnaacaaantctttgaancatttttttgaacana

SEQ ID NO: 1626 - DNA, 700 bp, Homo sapiens
  misc_feature (1)...(700): n = A,T,C or G
ttgacttcgtatacaatntcttgntctttttgcaggatccctcgattcgaattcggcacgagcgaagtcgggatcgaagaaagatcaaaaagccgggatcgaaagtcatataagcacagggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatctaagaatgaggtcaatgggaccagtgaagacattaaatctgaaggtgacactcagtccaattaaaactgatctgataagacctcagatcagacagaggactactgttcgaagatttttggaagaatactgagaacggcataaagtgaagatcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaaccttgtggcttgctcagtgttttaattgccagtttcaatcttggactttgaaacaggattaaccgtagtn

SEQ ID NO: 1627 - DNA, 703 bp, Homo sapiens
  misc_feature (1)...(703): n = A,T,C or G
ttanatacaagctacttgttctttttgcaggatccctcgattcgaattcggcacgagcttgagtctaggagttcaagaccagccttggcaacgtggctaaaccccattgctacaaaaatatatatatacaaaaaattagctgggagcggttggcacatgcctgtagtcccaactactcaggaagcccgangtgggagaattgcttgagtctggggagcagaggttgcagtgagctaaggtcatgccactgtactccagcctgacagagcaagaccctgtcccccgacaaaaaaaagcatcatgagcaactctcccaaggctggcccctgcacatgtcttcccatccaccaatagagtcccagttcatagccattgtcacaccattgtcctgtcttcctctcaactgagggtgatgtttagaggcatgatttctatctaatattgaagccagaggctcttccaacattttccagagtcttcttgtagaaaaggagctatggatgtttccttgaaaacangccccgattcctgtgacacacccatcacatgttgctcaaagctatcccaagatattaccaaatattggacatcctgtcctgggtgagcaggtagcagtgctaaggtaagacaaagttnccagttctgggagtcttcctacttccaagaaggccaatccttgagcagtgtggattnctgtggttat

SEQ ID NO: 1628 - DNA, 715 bp, Homo sapiens
  misc_feature (1)...(715): n = A,T,C or G
tttgaatccctttacaactncttgttctttttgcaggatcccatcgattcgcccctgtttacagcaataagcacgtcctcctccccnactcccattccaggattgtggtttggattgaaaccaagtttacaagtagacacccctgggggggcgggcagtggacaaggatggcaaggggtgggcattggggtgccaggcaggcatgtacagactctatatctctatatataatgtacagacagacagagtcccttccctctttaaccccctgacctttcttgacttccccttcagcttcagaccccttccccaccangctaggccccccacacctgggggaccccctggcccctcttttgtcttctgtgaagacaggacctatgcaacgcacagacacttttggagaccgtaaaacaacaagcgccccctcccttccagcccttgagccgggaaccatctcccaggaccttgccctgctcaccctatgtggtcccacctatnctcctgggccttttttnaagtgctttgggctgtgactttcatactctgctctttagtctaaaaaaaaataaactggagatnaaanttnnnnntnccaaannnnnananttnngnnnnncanngnnnnnnnnnnnnnnnnaaantnaatttnnntnnnanttgtntnnngctnttanaaatanantnnacccttncttntataaaattttgnnng

SEQ ID NO: 1629 - DNA, 694 bp, Homo sapiens
  misc_feature (1)...(694): n = A,T,C or G
ttcanatacaagctacttgttctttttgcaggatcccatcgattcgaattcggcacgaggcctacactagtgaattaatctgaaaggcactgtgtcagtggcatggcttgtatgcttgtcctgtggtgacagtttgtgacattctgtcttcatgaggtctcacagtcgacgctcctgtaatcattctttgtattcactccattcccctgtctgtctgcatttgtctcagacatttccttggctggacagatggggttatgcatttgcaataatttccttctgatttctctgtggaacgtgttcggtcccgagtgaggactgtgtgtctttttaccctgaagttagttgcatattcagaggtaaagttgtgtgctatcttggcagcatcttagagatggagacattaacaagctaatggtaattagaatcatttgaatttatttttttctaatatgtgaaacacagatttcaagtgttttatcttttttttttaaatttaaatgggaatataacacaagttttcccttccatattcctctcttgagtttatgcacatctctataaatcattaagttttctattttattacataaaattcttttagaaaatgcaaatagtgaactttgtgaatggatttttccatactcatctacaattcctccatttttaaatggactacttttatttttaaatt

SEQ ID NO: 1630 - DNA, 908 bp, Homo sapiens
  misc_feature (1)...(908): n = A,T,C or G
gaaaacccttttgaaatncccnnnttnaattcanatacaagctacttgttctttttgcaggatcccatcgattcgaattcggcacgaggtggcaaagcttcatccagtctaggtcttcaggattttgatttgctccgggtaataggaagaggaagttatgccaaagtactgttgggttcgattaaaaaaaacagatcgtattttatgcaatgaaagttggtgaaaaaagagcttgttaatgatgatgaggatattgattggggtacagacaggaagaagcatgtgtttgagcaggcatcccaatcatccctttcctttggttggggcctgcanttctttggcttttccagnacaggaaaagccaagaattggtttcttttggtttantaaggaagttantggttaaaaatggggaagggaagaacccntaaatggtttttccantaatggccaggccggaaccaaaaaggaaaaaaaccttttcccntggnaaagnaaaaccaattgnccccaagaaatttttttaacnttcttggccaagaaaaaaattcaaagttccttaagcccanttttaaaaaatttaattccttttcnattggaagcccgaaaggggaattaaanttttnantaaggaagaattttgnaaaaccttggggaccaaatggttatttaacctggggacntcntggaaaggcccaccantttaaaacntccactggacccaccggccattgtgttaaaggaaaggatttaccggccagggnaagataccaaccagcactttctggnggtacctnctaattacatgctcctggaaattttaagangagaagattatggnttcaatgttgactggtgggctcttggagtgctcatgtttgaagatgatggcaggaaggtctcctttt

SEQ ID NO: 1631 - DNA, 710 bp, Homo sapiens
  misc_feature (1)...(710): n = A,T,C or G
gaanccctttnnnnttnnaattcananacangctacttgttctttttgcaggatcccatcgattcgaattcggcacgagggaactaatgaaaaagtggttgtctctaaccttggtatgctttcagagcatcagggttaaattacctcaacttttggcaggtatactctaaagctattaagtatataatatgggctcggcatggtggctcacacctgtgagccacctagcactttggcagtccaaggcggacagatcacttcaggtcaggagtttgagaccagcctgtccgacgtggtgaaaccccatctctactaaaaatacaaaaaccgagcgtggtgggtggcatgcacctgtggtcccagctacttgggaggctgaggcaggagaatcgcttgaacccangaggcggaggttgcagtgagccaagactgtgccactgcatttcacctgggtgacagagggagactgtctcaaaaacaaaaaaacaaaaaacaatggctgggcacggtggctcacgcccgtaatcccagcactttgaaaggctgaggcgtgcctttatcacctgaggtcaagatgttgaaaaaccacctggtcaactttggtgaaactgtctctaccaaaaaatacaagaattangntggacatggtgtcnggcttctgtaatctcaacttantcangaagctgaggcangaaaaaatggctttgaat

SEQ ID NO: 1632 - DNA, 700 bp, Homo sapiens
  misc_feature (1)...(700): n = A,T,C or G
tttgaaaccctttgnnantncanttcananacaagctacttgttctttttgcaggatcccatcgattcgaattcggcacgagagatacattgaactcttcaggagcacagcagctgaagttcagcaggtgctgaatcgattctcctcggcccctctcattccacttccaacccctcccattattccagtactacctcagcaatttgtgccccctacaaatgttagagactgtatacgccttcgaggtcttccctatgcagccacaattgaggacatcctggatttcctgggggagttcgccacagatattcgtactcatggggttcacatggttttgaatcaccagggccgccatcaggagatgcctttatccagatgaagtctgcggacagagcatttatggctgcacagaagtgtcataaaaaaaacatgaaggacagatatgttgaagtctttcagtgttcagctgaggagatgaactttgtgttaatggggggcactttaaatcgaaatggcttatccccaccgccatgtaagttaccatgtaagtttttcttgggtcttggcgctattctacgctatatgctggtaggtgcttaagctgctttcgtaactttctggcccctggttctttctgagcaggtgaggtggttatataaggctcttccatctgtaatcagtagtacctggtaatcattta

SEQ ID NO: 1633 - DNA, 670 bp, Homo sapiens
  misc_feature (1)...(670): n = A,T,C or G
gntnaccnnccngnncnaaannacgcatnngngngnntggctnannntngcatttttagtagagatggggcttcacaatgctgcccaggtttttcnngaaccgctgaccttaancgaggngnctgccttggcctccccaaggtgcnggaatnacaggcatgagccaccgngcccggatgacanccgtattcattaagtgtctntncgngacagnctaatgancnagctancnnncatggaagtgcaatgccnncanngtnngttnttnanncctnaancngntgggnccaggtntatnaacnanctnacanncctgngtagagagggactacaggcgcatgccaccacacctggctattgtggattttaanaaattttttttgtanagacagggtcttactatgttgcccaggttgttcntganctcttgggctccagagagccttccatctcagcctcccaaagtgcntganatnataggcgtgagccaccacncttagcccattgtnactttttagagctctaatacttcctttaanggcactaaaaactcaatcttaaatccagttgntnttcatttgggtgaatgaaatggnagggaccctccttaattttttttccaggtttttgggattgaanaaatttcaannatcttcaaagcgacctaaan

SEQ ID NO: 1634 - DNA, 716 bp, Homo sapiens
  misc_feature (1)...(716): n = A,T,C or G
tcccntatacaagctacttgttctttttgcaggatcccatcgattcgaattcggcacgagctttaaacaaaaaatatgttatcctacacattagtgtcaatccaatggttgtctcttatctgtctaaatagcaaaatcatgaaaatcagctgttttatttgcataggacaactaacctgtctgtgtaactttgtttttattttaactcttactagaaaatctaatcttaaaacatttgaattctaaacatgtaaaatgtgacagcctgcaattttgtagacagtgaagtaatggctgctatttataaatggaacatctatcaaaataagtaactgtttataaaattcagtttttgtagggttttccaaggaaaaatcaccttggttgaatgtttctcactcattaaactttgcagaagtgattcatattcagtactgtttttaatcactttttaaaatataaggaccgaatgcaaggaaaccaaagtttattaataatttttatataactaaaataaaatagatgtggagggatctgtgatcatataaaaaggganggttactgaaaagaattttagcaatatattggtttcagggaaaanggagctgtttttattaaaatggatccattccactggntccctaatgggttcctatggtatcctttccaaacccggattacccttttacttatttttaaaaagnagccggtaaaat

SEQ ID NO: 1635 - DNA, 691 bp, Homo sapiens
  misc_feature (1)...(691): n = A,T,C or G
accnnaaaccctttgcaactncttgttctttttgcaggatcccatcgattcgaattcggcacgaggttggcttccccgggagaggantttgaggattaaaaatattcagaaacaaacaaaagaacacaaaaatgcaaacacatggtanggaattactactgcttattctcaacagtaccacagaaccagtgtttgagtgctggcaccatatgcaacatggggcatccgggctggagtgatccagttttttagttggtggtggcgatgatttttctttccttttggtttataattttctgttcatttttccccctttctcccccacattcattaagaaccctactgaaaccctaggtgacaaaaggtgtgccttctgttgccacatttgacccaccacaggactcactggactggacttctatttatattgtattaagtaactgatatatatatatatatatatatatatatatttttgattgacaccaaaaaattaccttggcacaaatgccagacctgtgaaggtcagaggcccgctgcttcttccaggagggagggaactttttggttgctgtggcaattcctctgtacagattgtaacttttttaaaaatttcccttcacccccgtcacttgaatatatgttcatagtaatttgtaagaatacttctttttccttattttgggtgcaa

SEQ ID NO: 1636 - DNA, 686 bp, Homo sapiens
  misc_feature (1)...(686): n = A,T,C or G
tttgaatccntttacanctacttgttctttttgcaggatcccatcgattcggcagagttggccttttgcccgtggtgtgctagtanctttggctgatgctaagctttcctggtatgcgccctatttttaagaagtaattgcttttgaattaagttatagcattactaattcatgttaatgactaggaaaccctctgtaatttacaagatttttcaaattggtggggagtgaataaatacaatttaaaagagtcagaaatcagtttggcaaagtgtactttcttaatttctatttatgatgaagtatancataatttatttgtaatactactttatggtataccagtgaaagaactgtagtataaaaaagaggtattaatgttttatgaaatctcatgcatcagttcatagcataaaatctagctggacaactaagaagctatggtagcaaacagtgatgttgatggaatgagaatcatgaactttcatattacctcaaaggatttttttatcagtttttttcacacatcagaaaaaactgactgtataaacacttatcactgacctttttctatgtgnagttttgccttttatcttttcccaaattttataaagagaaattaatnaatattttattacacattgtaaaaaaaaaaaaaaaaaaaactcgagcctntagaactatan

SEQ ID NO: 1637 - DNA, 710 bp, Homo sapiens
  misc_feature (1)...(710): n = A,T,C or G
ttccgtatacagctacttgttctttttgcaggatcccatcgattcgaattcggcacgaggcaaggtgcagtagctcacgcctgtaatcccagcactttgggaggccgagacagggaggattgctttagaccaggagttcaggaccagcctggccaacacagtgaggccctgtctacaaaaaattaaaataatcacttaaaaaaatcaaatattcttgaaaaagtttagacttgtaaaatataatatggggaaaatggacatggtagaaatganaaactacaaaataaaacacagacagacagacctgtgattggtaaatatttgatagggtccagaaaaacttatggatgaatcaaatcataattgtataatttgcctacaaaagaactgatccagatcaaaataatttcaggagactaaagtgaaaatggaaacatttggaantctgttaaacaactggcttaatgaactttgctctagaaaataccctctcaatgaaaatgaactttgctatggtatatttttcttttaaatagttgtagtcatgaacatggagtcaaaatgctctctgggctatcaattttttctcttaaaacaaggcttttggcttgcattcccacaaggtctttaaataccgtaantattttccnttatttnttccagaatcaaaantattttnccaaatcccttttggggantttcttctttcc

SEQ ID NO: 1638 - DNA, 685 bp, Homo sapiens
  misc_feature (1)...(685): n = A,T,C or G
ttcanatcagctcttgttctttttgcaggatccctcgattcgaattcggcacgagtgaaattcagctaaccgagcagctacggtccctcatccccaacgagggatgtgagaaagttcatgtctcatgttatctggaccttgaaaatggaatgttcagaacacatgtgcaagggagctgtgccaagctcatgtcgcgaacaggcctcctgatgaagcttctcagcgagcagcaggaagcaaaggcattgaatgtagaatgggatacggaccaacaaaaaacaaattatattaatgagaacatggaacagaatgaacagaaagagcagaagtcaagtgagctcatgaaagaagttccaggatatgactataagaacaaactcatcttcgcaatatctgtgactgtcatactaataattttgattataattttttgttttatagaggtaaagacaataattaattcaggttttcaaaatacaatcctgtgtttgtgtggattcagaatccacaaactgaaaaccaacgtcactttcccacttgacattcttcttctgtcatttaaaggctgangtgtgctttgttcttttactgcaatgtatattccaggattggtaaaggatcctcgcttncaggaggtctctgtgaaataaaacccaagttaatcccaaaaaaaaaaaaaaaaaat

SEQ ID NO: 1639 - DNA, 683 bp, Homo sapiens
ttcgatcagctcttgttctttttgcaggatcccatcgattcggaaagattctcaaggaagaagtaataaggcattacatctgaagagtgatgctgaatttaaaaagatatttggccttactaaggatttgagagtgtgccttactcgaattcctgccatttgacctctggagaaggtttcgattcctttagcagtttggtaaagagtggtacttacaaagagacagagtttatggtgaaggaaggagagagaaaacagcagaattttgataagaaaagaaaagcaaaaactaataagaagatggatcacataaagaagagaaaaacagagaatgcttataacgcaatcataaatggggaagctaatgtcaccggttcccaactcctaagcagtattttaccaacttcagatgtgtcacaacataacattctcacgagtcacagcaaaaccagacaagaaaagagaactgagatggaatactatacccatgagaagcaagagaaaggcctttgaattcaaatgcagcttatgaacaaagtcatttcttcaataaaaattataccgaagatattttcccagtgacaccacccggagttagaagaaaccattcgagatgaaaaaataagaagactttaagcaggtgctgagagagaaagaagcagctcttgaagaaatgccttaga

SEQ ID NO: 1640 - DNA, 689 bp, Homo sapiens
  misc_feature (1)...(689): n = A,T,C or G
ttcanatacaagctacttgttctttttgcaggatcccatcgattcgaattcggcacgagagaagaatttggtataatcatgaaagccctgtggacaggacagtatagatatatcagtccaaagggactttaaaatcccattggggaagatcaatgaccaagtttgcaggatacagtcagcaagattcacaagaattgcttctgttcctaatggatgggtctccatgaagatctaaataaagctgataatcggaagagatataaagaagaaaataatgatcatctcgatgactttaaagctgcagaacatgcctggcagaaacacaagcagctcaatgagtctattattgttgcactttttcagggtcaattcaaatctacagtacagtgcctcacatgtcacaaaaagtctaggacatttgaggccttcatgtatttgtctctccactagcatccacaagtaaatgtacattacaggattgccttagattattttccaaagaagaaaactcacagataacaacagattttactgcagtcattgcagagctcgacgggattctctaaaaaagatagaaatctggaagttaccacctgtgcttttagtgcatctgaaacgtttttnctacgatggcaggtgggaaacaaaaaattacagacatctgtggacttncccgtaagaaaatcttg

SEQ ID NO: 1641 - DNA, 683 bp, Homo sapiens
  misc_feature (1)...(683): n = A,T,C or G
ttcananacaagctacttgttctttttgcaggatcccatcgattcgaattcggcacgaggtttcttgtaagtactctgggagtgcataatacattttaaataagattaaaaattatgttttattcttactagcatcactgtcagataattgagccgtgagagcattcagtgctgtgtgcttggtaccgaagtagtaacatcaattcagtgttcagtacatccactttgttccagaacaatgtattcaaggtcggtgtattttggctgtgccacagagttctggaaattcccaagagaataagttttcacctgttatataatccagcacaagtgactgtgtagcagcaacctcatgtttcatgatgactttaaaatgcaattgattctaaaatttagcttttaaaaatttcgacttcagattttctctgaaggtttaaggtaggcttctcctttattaatttttttcaagaaatatttaagaacactgctctgtgctatgtaccattctaagcactttacagatactaattcatttaatcctcagccctgntaggtaagtactgctattccccccgtccagatgangaaacagcctcagaggagtaaaacaggttgctcangtacacggcagcgggttggactactcagtttcagataatcactgngaaattttactggtttga

SEQ ID NO: 1642 - DNA, 716 bp, Homo sapiens
  misc_feature (1)...(716): n = A,T,C or G
tntcanatacagctcttgttctttttgcaggatcccatcgattcgaattcggcacgagggaacctcacctgtggctcagctcaccccacatccgtttctcattacgtgtaaataaactgtcagagctgatgttacagcttttacagtttaaagcattcccctcgtctctagttccttttttcttgtttacatgttttgggcactttccctcattcaccaccttccagggtttcatagaaaataacttgttacaaaatcagttcaattctaatgtggacatagtggcatgttcataattagacccatataggggacactgagctttaaatcgttgattctaaactctatacattaaaaaaattcagcccaggcccctcaaagcctgagaaaatttaatttgctcttaatttaatgttccaaaactcactcttggaaaaatgcctgttggaaaactacaggtgggtcacatgtgggggctgtctccgtgacactcaggattccagtcagaacctaatcctcatatctattgcctacaaaaatagaccaagaatgttgctgctcttttataatcctttaaatatttaacattcaagttttcttttgtcttaaattcagcctctttcttaaaagcaaaaaaaaagcctcttagaactatagtgagtcgtattacgtagatccagacatgataaagatacattgatgagtttggacaaacc

SEQ ID NO: 1643 - DNA, 809 bp, Homo sapiens
  misc_feature (1)...(809): n = A,T,C or G
ttgaattccnatacanctacttgttctttttgcaggatcccatcgattcgaaaaaataaaagtaaattctaggcaagctaaagagtgaaatgtatcatcacataggaggaagtgggggaaaaaagtgaaatgtaagaaatgaaatgataagaagaacttagtgggtattcgtttgattttggaggcactctaggaaaattctgccagattgtactacatttaaaaaaaattttttttaacttttgtgtgcttcagtttggtcatagacaaatgaaaaggcacatcacaaactaaaaagaaaatcagttcctatatatgataaagggttaatatgtttttatatggagagttcatataaatcaataaacaaaacactaataccctgtacaaataatagacctatcaggcatcgtttctgatgccgttctctgatgaaagggaaccagggctcctcagagaaatggctgatgcgaggactgagaaaatacaccagtatggtaggtcaaggcaccggtggctcacgcctataatcccagcactttggggaaagcccgaangtggagccgggatccactttgnanggtccangggaagtttccaaagaaaccaggcccttgggncccaaccattggggtaaaaaaaccccccatcttcttactttaaaaaaaattcccaaaggattttagcccccaggccgtnggtngggtncccattacccttgttaaatccccagccttacttcaaggaaaggcctttaaggccaaggaanggaattggttttggaacccccccaaaaanggccaaaangg

SEQ ID NO: 1644 - DNA, 1387 bp, Homo sapiens
  misc_feature (1)...(1387): n = A,T,C or G
ccgctcngcannnncttcctntgacgcgcgnttntntgntgtnnnanncnncngtatgtncncntnnaccnntgcgnctnntcagcgtctacganntggngntcatataggggggngattnacactgngngggtcnttagnncgttttggaaaaacccntctggcagcgnccngcgaggtnnancganctcgctantaagngngggcnntaannngnnantnnngtnaggngcagtgnntnnntnnaggnnaattggnnnntantgntgnngnaacntnatangtcnangttnantntngncngatatggnnttctgntatcgtnnnnntcnntannnantnngnngnntgtcntgatgntnnngcntgtnnnaagannncttntntcntgtgnntnnntgtncttcggntgtgtnnnttngncccctaatnccngntnncannnttcntgctggnanctnnncnntccntttttgntnatnntccnngtcngcntgnccnnnnngnctnncgcnnnnnanttccgnnantagcnnagctntggnngctctnnnnntagnngatnncnngtgctantncancngantntnnnnnnacgccgctacgncnctntcngatcgtacnncantgtgntncnncanacnnnacngntntnagcncagnanngtntacgcntctngtaccncgcannntcgangcgcngtnnagtctgggcgtnnntngnnanatgatntcggntcccacntnntnngcgcntgcaaagagtgtnatnncncntnngcncannggtgtnacatacaganacantagcnggagcgcctnattntgngtctanntacgctntntgtganngatntacatctnanntggcntgcnacntnanntnatgncgcnantnntganntnnnggagangttcagcnncaaattggcacgngcatntngnncttcagtgacgcnntcgnnantnnannacacncttgnctgtantgtcgtnatcnntaaccacnctntcttactnngnngntcnncgggnnngaagnnnatnnntncnnncgnatgcgcagatacgctnggnncganattgngcttgtncacgctcagcacngttntnacagngtnnntntcctnnctgtcgncatgncnncggncatnncgtnagtntgtacgtacngcggcaatantctnatntangctcancntnagcncnnnctgcnngagtntnngtncatgtannganagatnatancgtnanttnntgnagnngtnncgcccngnngannngtacatactctgtnntnnnngatctccncgctncgctgntctctncgngtnntatnancgacgtttnnacagnnanntcancntnactcccgntctgatnnnng

SEQ ID NO: 1645 - DNA, 1492 bp, Homo sapiens
  misc_feature (1)...(1492): n = A,T,C or G
acgtcnntctgtccncattacnctatnnacacacgtgnancctngacgnncacnctgtgtctatcnnctnganannataacnttgttgcnntgncgnnannacgagttcnnctantgntgcattancacgagaggnctctncatttatntnngngggcacnccgcgncgttttggtaaatcccntattgtnatggaacgagtcngctancaacatcntgatnnntagntcccgatcannatgaagcnntangcatcctcngaanctnnatnggtanatnttnatntagcnnnnnnnttgcgnacnctngananatagnggacnctagntagtannntagtccatnacntatctnntgtnnnaaancctncannaccntctggcntgaaaanatacnntnannttnggannnncncgnncgtgtnancagnngggntggattgtnttgntgtgngcnctatncnctgnggnctaaatnntantntactgnnntnannnnntaagnntcnnnctnannncaancnnggcnnttgagatntgnacganttaggngtnnatcngnntaggnntatcnnntnnnantganataangcnntnntntnctcantggntcgngcgctgcttntcttggcagngtagtnntgcnnacnnatgngngcnctnacncacngcacncncntcancngatgnnctantcacagnaccaacatncncantancttnanantactnacnactgacgcnnntgtntctcgccntcnngagganancnnngacatgtctcngaacantccncnncntcacatntctcngcncgttcactnnntatgcnaagcnnntgaccgaccnttctntctntacatatcgttngtnntgtnnatnacacgcattctntcnccaanctatncnccntcacnnngtagaganaacncgattnnntacttnncgatagcgcgcnnntatactnnttacatanatcactacttnngcgatnatctnaatacnatacnntgcggtcagccnatntgaacnnctcgaacactcngngacntntnnatntntcanncatgnatnnnanatacttgtgtgntnagcacacttannctgagcgtancngctntatcgtnacagcnttcgntntacacagancatacnttgntntancgtatnnacnctatantgcaccntancnactgatntngtatnngnaggtgangntnaagnggancnntnnaanntgncntancttctcctncngnggnncgnacncancnncntgagagtcnngtnntgncancttntatcnaannaancncnactntacgccntgatcnnnngtctcgcngtntnnntgtatattgncgatctaaatanncnntgttgcgnntntataagacnnctgctctnnatgctctgnntcactagnncagtctcnttcnntgnacaganngactgctntanncntacgctctcgtgtntgnccctcnnatccg

SEQ ID NO: 1646 - DNA, 710 bp, Homo sapiens
  misc_feature (1)...(710): n = A,T,C or G
ttcanatacanctcttgttctttttgcaggatcccatcgattcgaattcggcacgagggataccgtatcgacgtggggcctccggttgctgctaaatgggaaaaacttagcttagtactgatagatgactttattgaaagtggaactgaacaagtactcctactttttaaggactccttgaactcagactgcctgacttcatttaaaataacggatcttggaaaaataaactattcgagtgaaccatcagattgcaatgaagatgacttatttgaagacaaacaagagaatcgttacctggtggttccacctctagaaacaggactgaaaagcacatggaagatctttttgcacttcttgcagcattccataaatcttgttttcaaatcacatcacccggctatgccctgaattcaatgaaggtgtggctcttagaacatatgaaatgtgaaataatcaaagaatttccagaagtgtacttttgtgaaagaccgggaagtttctatgggacactcttcacttggaaacagagaacaccattcgaagggattttaataatctattccaggaatcaaacagttatgttccagtgccttcataatctcatcagaattcttccttataaactgtttcctcaaaaatctaaaatcaggaagtgagaatttcctaattgataatatggcatttactttggagaaggactagtcacc

SEQ ID NO: 1647 - DNA, 721 bp, Homo sapiens
  misc_feature (1)...(721): n = A,T,C or G
ttcnatcagctcttgttctttttgcaggatcccatcgattcgacctcaaaaaaaatgctgatatcctaaaatattcctagtatcctaaaatattccataaatcagatatcctacaaagccaaactggtccttcttgttaaaattaataagattctataagctgttaaccaaaaaagtttccactaacactgcatacttaactctcctaaataaatttaaatatgcaaaatgttaattcaaatcaaaataataataaacacaaccataaagctagcaattaagattaaaaggtttatgagtgtctattaaaggataaatggataaagaaaatgtgatatctgtatacaatggaatactattcagctataaaaatgaatgaaatcatgtctttttgtggcaacgtggatggaactggaagccattatcttaagtgaaacagctcagaaacagaaagtcaaatatgctggaagatcttctctgattactttaattttctaagccaggtcattggcttagtaagaaaggaagctattaggagtttgaaaagagaggagagcatataattgtctagaaagtgggaaagtgaatggactagagaaatacagtatgatcaccangccagtgttaangggctcatttgaggctaaagggtctgagttnaaaagtgganggccnggtcagcnttgggttttggngcttttttttcttccagccccctttn

SEQ ID NO: 1648 - DNA, 712 bp, Homo sapiens
  misc_feature (1)...(712): n = A,T,C or G
tacanctcttgttctttttgcaggatcccatcgattcgaattcggcacgagcgcgacgcacattgatggagcgtatgtccaggcgccggtgcaccgcaaggagcaaaacagacacagttcttggtcctagggctcacgtcccggggcgaagaggatcctccataaacgatcagccatagcagctgtgattggacaagagactgatttcagtgactttctcctgataagagaccaccgaccagctgaccatgccgaccagctgacccgttaatagagagagatgatgcacctgcatgcctttgtgtcctgaaaagacgttttgccataaaggccctaattgtaagatgtgtaaatgttaagtctccaccccaaagtgaacatgggtcatatattacatgctttgctcaataagagggcatgtgtcaggaccaccttcatgaatattcatagctcctnctgttacctgttgaatatgtatgtttagccaatcccttcagcatagcgctccttgccccaacccctcctncttggacgtgcctgtctctggccttggctggagacagattcccagcctcagacagatggccgncacctttgcaggctacgaaccgtttacaaaaaaataaagccttctnttttttccnnnnnaaannnnnnnnnnnnnnnnnnnnnnnnnnnnnnnnnnnnnnnnnnnnnnnnnntnnntnnnnnn

SEQ ID NO: 1649 - DNA, 678 bp, Homo sapiens
  misc_feature (1)...(678): n = A,T,C or G
ttgnaattcanatcagctcttgttctttttgcaggatccctcgattcgaattcggcacgagggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaagaaacaggaaaaactcctaaaacaccaaaaaggcctagttcttgtagaagacattaagcanaaatgccagcnagtatagaaaaagcgcattgacagtcctgggcctcatgtaaattaagcccaaagatggggagaaggaaaaggagagacaaatatagtccatctgagtgtatcaccatncagctgagtttcttttattnatccctttctgttgcaccatcctttcngtggaacatnttggtcctaaccttntttgntgtnngttca

SEQ ID NO: 1650 - DNA, 817 bp, Homo sapiens
  misc_feature (1)...(817): n = A,T,C or G
ttgnaatttcanatacanctacttgttctttttgcaggatcccatcgattcgcctgatcctgccaacagcagttcaggccagccccacatggagcaagtacctgaggcccagccccttggggacttgcccatcctggaagtggaggagatggagcccccgccggttatggagtcctcccagcccgcccaggccaccgccccgcttgactctgggtgtgagaagcacttcctgcccacacctgaggagctgggccttctggggccccccaggccacaggttctggcctgaaccacacgtctggctgggggctgccagccaggctagagggatgctcatgcaggttgcaccccagtcctggattagccctcttgatggatgaagacactgaggactcanagaggctgagtcacttacctgaggacacccagccaggcagagctgggattgaaggacccctatagagaagggcttggcccccatggggaagacacggatggaaggtggagcaaaggaaaatacatgaaattgaagagtggcaacttgccttgcaaaatctgtttccgttgtaacaagaacttgaattttgggacccccaagccncaattggggcttnacgnccttggtaaattccccaaacaacttttttggccangggccccaaangggtnggggaaaggggaatcaacntttaanaaggccttttggngaagttttttggnaaaaaaccaagccccttggggggccaaattntttnncccaagggaaacccccttttaaattttccaaaaaaaatttaaaaaacccnttttcaaaana

SEQ ID NO: 1651 - DNA, 718 bp, Homo sapiens
  misc_feature (1)...(718): n = A,T,C or G
gaaattcanatacanctattgttctttttgcaggatcccatcgattcgaattcggcacgaggtgactccaagcccccgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcactccccccgaatccaagcccaacttcacccctctcgccatcttggcccatgttctcggcgccatccagccctatgcccacctcatccacgtccagcgactcatcccccgtcaggtctgttgcagggtttgtttggttttctgttgctgccgttgttctctcattggctcggtcctctcttcatgcagtgttcagcctcctcgtcaactttgttccctgccatccaaacctgcacttgctttttgacaggccagaagaagcggtacatgaagactccacacaccgttccggaaggcaaaagccttgtatgcctgcaaagcttgaacatgactcaaaactttcgttcacagcaggcacggtcttcgataatgcagaagtggtccttcagcttncaacagccatttttnactggcacaccggaancttccggggcacct

SEQ ID NO: 1652 - DNA, 709 bp, Homo sapiens
  misc_feature (1)...(709): n = A,T,C or G
canatacagctcttgttctttttgcaggatccctcgattcgaattcggcacgagtcaggctgggagggacttcagttngcatggtgggggagaaccagtaccacatacccagtaggtaataaggtgtccagcagaggatgaaggtcagcaagataagcagggccagtctcagggcccggagacgaacacggggacaattgtcaaaggagcgggggagggcaaattnaccagcaggggctaggaatttagaaaatatactgtaattcagacactcagcttctgatctgagtatagggtgaattgatggaggggcatagctagtgagacagagctcgcctcctacaaggaggagaatgttgcaaaccgttttccccttcccaacctgggactatatgatttcttacccccagggattatgatagaaatatgaagccaccaagtctagacttgatggtgttcaagaataaataatactgattgcctccctagtccttgtccagctaactcagctgtttataattgaagggattcaacaaaattatctctagcatcaggtgctagacatggttagaatctcaccatggtttantgactggtagatagctattangtanggtaggataaaataaatgatgctagaggcaacaggtctanggttaaggattaaggccttggaaattgggaatctcaccatggctccccttccttg

SEQ ID NO: 1653 - DNA, 1595 bp, Homo sapiens
  misc_feature (1)...(1595): n = A,T,C or G
gntttaaaaaggaaaaanggatgannagganggttantntncgatnggangnnntnacgnanaattcggacnttgtcnngatancgnnncntntcgtntgtcacnnnntnatatgatntctngcgcntgtgaggggtctcnagcntgcgnaccnnntgttactgaganngagancncncantagaagagtacgccnatatctgggngacggntnccagctgncnnnttttggnaaaangcccttcagtgccaanagcntnttcnatcntnatatnnctacnctcagannnatngncctgananagngnannncatnntgganatgcnntnggncatatntgntnntnagagnanncagttngnngncnnnnntggangatnngnttganntnatnatcagcntnnacctntntnnnccgtgngaatatnctngntncngngnttnagggnttgcngtncggnttgcncaggantnttgannnntncgtncncnnntcnnnnangtnctngncngnntagtgacngantnaangaggtcntnngnntcnntntnngnnngnttnnagnatanngcgcacgannnnctgtngnngnnnncncntnnntcanctnncnaaaccntanactggatangtantnncgnannnntncntntgtatatntntcncngtatnttcgccncacatntgagctatnatnatagatcnnnnatcgcanngnncatatgnacgnatnggagtcngcagctgcacanggaggacacgngtgntnanagtgntatatnagagcanatgnnacncnnngannctcacgnaatannatgtggcacngtagattcatgctanagagcncgngngcngnacagcntnnatgatannagnttgtnagcgatcnatnnanttngatncacannnnctnnntcgttntnnnncncagttncacgcgtgagcanagtagagnacnttgnannncgaatgnntnctgtatcgcacgnncttgcgtacacantntnnanacgngcnattatntgcgnnccncgctgcncgcgctnacnnctnanatcgcntttgacgcnnagtatgattgnatggcgntgcncgtgnnanncgnatnntggacgnatntgtgncgttntncgcncannnncgntctntggnnttagaganacgtgtntcactgnntagnagaggncgnttgnnacggtnacagtntctgngatagantgaangagtagatgcancnganaagggtgtcnctagtncacgcgnntnacntcnnttgtngaatgacntcatctngatatggcncggngccgatatgactnactcgctacangtgtctngatttncgnntgacgagnntcgcgngagcntactcantgnctntatggngcgnncgnatatnnctatnnnttgntagtcngtccatcantntncaancgattagtcgncacgntnnccgcattacgatgatgaccnnacgataggnatngctctnngtctnatcncacantnanganctattnnatnagaancatgnnaannnttggtactatcgnatangtctnnanctatnaaggttatcgaacacnagcg

SEQ ID NO: 1654 - DNA, 776 bp, Homo sapiens
  misc_feature (1)...(776): n = A,T,C or G
tttcanatacanctcttgttctttttgcaggatcccatcgattcgaattcggcacgaggtcaccaacttgaaaccagcaaccatcaaggtctatgactactacctaccagatgaacaggcaacaattcagtattctgatccctgtgaatgaggataggagctggaaactcaattagtcctctgtgacattactggagggtggaacattcttctgtcgcttgaagcagaactcattcaatcaaataatttaatttctctgactagtatatgggtaacaaatgaatatgtctgaacctcagctataatactttctactacctttgcaaggagatgggataggaacaatcactcagaggaggcgttgcatggacagggtcattagggggaagaaaggngggttaactggtttatttaaccattcagggggctctncaaananganaccgtggtaganggtgactanaaaagataagaatgtctttcttagggccggttgccggtngctcacccctggtaattcccancacttttgggaattgcnaagggtgggccggaatcantttganggtcaagggagtttcaaaanaaccaagccttgcccaaacaattgggaaaaaacccccgtcttttttcttaacccaatttccaaaaaaattttnccccttggtggttgggtnggcaaccggggccctnttaattcccaacccccctttgggaaangggccnaaggcaagggaaaaaatccncctttnaacacttggaagggtggaagggtt

SEQ ID NO: 1655 - DNA, 762 bp, Homo sapiens
  misc_feature (1)...(762): n = A,T,C or G
gnnnnttnntttgattgntctngctcttgttctttntgcaggatcccatcgattcgaattcggcacgaggtcaccaacttgaaaccagcaaccatcaaggtctatgactactacctaccagatgaacaggcaacaattcagtattctgatccctgtgaatgaggataggagctggaaactcaattagtcctctgtgacattactggagggtggaacattcttctgtcgcttgaagcagaactcattcaatcaaataatttaatttctctgactagtatatgggtaacaaatgaatatgtctgaacctcagctataatactttctactacctttgcaaggagatgggataggaacaatcactcagaggaggcgttgcatggacagggtcatagggggaagaaaggtggtttagctgttttatttagccattcagggggctctccagagaggagacggtggtagagggtgaactagagaagataagaatgtcttcctaggccggatgcggtggctcacgcctgtaatcccagcactttgggattgcgaggtgggcggatcacttgaggtcaggagttcaagaccagcctggccaacatggtaaaacccgtctctactaacaatacaaaaattagcctggtgtggtggcacgggcctgtaatcgcaaccccttggaaggccaaggcaggagaatcgcctnaacactggaggtggangttgcagtgaacctgagaatgngccactgnacttcancctgggcaatgg

SEQ ID NO: 1656 - DNA, 703 bp, Homo sapiens
  misc_feature (1)...(703): n = A,T,C or G
ttcanatacanctacttgttctttttgcaggatcccatcgattcgaattcggcacgaggttggcttccccgggagaggagtatgaggattaaaaatattcagaaacaaacaaaagaacacaaaaatgcaaacacatggtagggaattactactgcttattctcaacagtaccacagaaccagtgtttgagtgctggcaccatatgcaacatggggcatccgggctggagtgatccagttttttagttggtggtggcgatgatttttctttccttttggtttataattttctgttcatttttccccctttctcccccacattcattaagaaccctactgaaaccctaggtgacaaaaggtgtgccttctgttgccacatttgacccaccacaggactcactggactggacttctatttatattgtattaagtaactgatatatatatatatatatatatatatatatttttgattgacaccaaaaaattaccttggcacaaatgccagacctgtgaaggtcagaggcccgctgcttctcccaggagggagggaactttttggntgtctgtggcaattcctctgtacagattgtaactttttaaaaatttcccttcaccccgtcacttgaatatatgttcatagtaaatttgtaaganacttcttttccttattttggtgcaagaaccttccgacacattctgtt

SEQ ID NO: 1657 - DNA, 858 bp, Homo sapiens
  misc_feature (1)...(858): n = A,T,C or G
atncanatacaactacttgttctttttgcaggnatcccatcgattcggctcagtgctggcatgttgacctggtgttgtcagtgagtctgtggatccagggtcagtgctggtatgtttagctgacattggcagtgagtccatggatccaggctcagtgctggtatgttgacctggtgttgtcagtgagtctgtggatccaggctcagtgctggtatgttgacctagcattggcactgagtctgtggattcaggctcagttgctggtatgttgacctgacattagcagtgagtctgtggatccaggctcagtttcacagaggtttgtataaacatggtctcaggtgggttcttgacacctgggtttcaagcacaaaagtactggctgggcttgttaggtgaagtggggtggggtctaccacnatgaatnncataattctgaaggctttgccaanccctnggggaaaggtggggttcaaaacacaaggttgaanaaccctttccgntgggttaggggtccaagancaccaaattaagggtgaanttaagtggttgnggccttctttattattcnaaagggggnaaaaggcccngtaattncaatttgggtaaagggtgggtttnggtcaacccntggggggnttcttggcccttggggttggnatngtctcttnaagggggaaaaccccccttanaaaggaattccangccttnnggggnaccaaggggtaaatccttngttccctcaagncaaccnccttgggttccnagggtctntngantaagaaccangaaacttccaggggttnaaataacaaaaagggggcttntaanggaatcttggttnaaccccaagnccct

SEQ ID NO: 1658 - DNA, 704 bp, Homo sapiens
  misc_feature (1)...(704): n = A,T,C or G
ttgaatcccnnatacaagctcttgttctttttgcaggatccctcgattcgcaccactcttgtgcagtcatcctaaatataggttcagagcatctcctgtgaatgacatattttgtcaatcactgccaggatctccatttaagcccctcaccctgaggcagctggagcagcaggaagaaatactaagggtgccttttaggagaaataaagagggtgtcggttggtggaaatatgaattctgctatggcaaacatgtacatcaataccatgaggacaaggatagtgggaaaacctctgtggttgtcgggacatggaaccaagaagagcatattgaatgggctaagaagaatactgctagagcttatcatcttcaagacgatggtacccagacagtcaggatggtgtcacatttttatggaaatggagatatttgtgatataactgacaaaccaagacaggtgactgtaaaactaaagtgcaaagaatcagattcacctcatgctggtactgtatatatgctagagcctcactcctgtcaatatattcttggggttgaatctccagtgatctgtaaaatcttagatcnagccagattgaaaatgggctttctttctcttccccaactaaaaggatattaaagttagggggaaagaaaaaancatttgaagtcatgattaatttctgtcccactgngtctcatnataa

SEQ ID NO: 1659 - DNA, 700 bp, Homo sapiens
  misc_feature (1)...(700): n = A,T,C or G
ttgnantcccnatacaagctacttgttctttttgcaggatcccatcgattcgcagaaatcagcatgcatgaattaatcgaaatacaatgcatattaaacaatgcaattactatagtctaaatcaccaaactgataacccatacaaaagtagctcttacaactttttttgagaatatttcccctaaaaaattccagtgatcatcccaacctacaaaactagattattttactagtatcatcttctctttacccctcttctccccaccaacactccctccaacacacacacacttctccttaagagaaacggcttcctcaagaaattatctgatggttcagtagcagttggagttttacacaaactatgttgtgattgggcaaggcagactaccagatctgggattcagtagaccattccttactgtcagattatcttctaagtgactgctcttagagaaacaacacagatttgcctcaagagattacaaatgtggtaggcctaccttaacagcaactagttttttttaagaaacacggtcgcactgtcgcccaggcaggaacacaatggcatgattatgctcactgcacctcaaactnctaagttcaagtgatccttctgcctcagctnctggaatagctcaaactataggcatatgccaccatacccaagctaggtttttcggttttttggttttttaaa

SEQ ID NO: 1660 - DNA, 697 bp, Homo sapiens
  misc_feature (1)...(697): n = A,T,C or G
gaattcanatacaagctacttgttctttttgcaggatcccatcgattcgaattcggcacgagaaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatattccagccagcagagaattttgacttgcagtaggatttggtttgattttcctacgatctgggtggatgccttgcctgtgacagttgcagttcctattcgccaaatgaagggcagtgccccgcacgtaagttggaatgatggacctgtgttcagagacttaacagaccaacaagcaaaacaagtgagaacaggaaaaaggaagangacactggaatcaattcttgagagttgcactacttggtttttcttccattccaagtttcgtgggacccaganccttttttcttttaaaagctaaaaaaacaagtgtttaattcctctttt

SEQ ID NO: 1661 - DNA, 698 bp, Homo sapiens
  misc_feature (1)...(698): n = A,T,C or G
ttgantncatatacaagctacttgttctttttgcaggatcccatcgattcgaattcggcacgaggcacccagccggcttcatctcttcttgaaatcacttttataccattctatgtggttctcaccatgagcttgagtggtgggctaaagtgcctctccctgctttcagcttcctgctgggaactcactctctcaagttccttccagcaccaccccatagagttcccatcactccacactgtccagtgacaactcccaacatggaagatctgctagttctacagggtgctctctggctgccccagtaacatgtgtttttaaatttttcacatgcatgtttgaccccgactccccgaagtcaggtactgtaactagcagtgtcatttaagaaaaagccctttaacctctctttgccaaaggattcttatcagcaaaacagtgatgaaacaacaatcccataacagctagctggctaccttctcaagcacttattaaatgaggcataatgattttgcttaatcctcaatcctgagaggtgggcgatccctgtggtgatgaggaaaccgaggcttgggggttaatggcttgcctagattcacactgctagccaaggaatgaactgggaatttacaccctgaccctgactgcttttcacattttctacacagccttttcaagatcctgccaattctaaaaat

SEQ ID NO: 1662 - DNA, 705 bp, Homo sapiens
  misc_feature (1)...(705): n = A,T,C or G
ttcanatacaagctacttgttctttttgcagggatcccatcgattcgaattcggcacgagccgactagtaacataaatcatagcttccaaagtatttgtttacagaataccacagtgactaattaccagacttttcttattctctctgagcaaaggaacctcatgggagaaaaaaaatataggtcatttttaatgtaagggagttgctaggattggaggttaagacaactatttaaacttcataaaaggaaaaacaaaagacctcaaaaagtattttctaaaatagagaaaggtgcaaatcttcttatcagaaacgcattataaatagaaaagaaactcttaaaagagattcttcaaatgtgacaaaaagctcttggtttcctgaaaatgtcaaaaacaaaaacaaatattgacaatactaaatatccaacagacagggtaagaacttcacttagaagcaaatttccatttaggtaatttatggtgcttctgtgcaaaaagttgctttacactgtgtagtcgctgaagacactccagaattgctagaccttcacaggaaaaattttaaaggtcaggggtttttttttctttcccttagttagcacagccactcanggggcagccagttctctaacgtctgagtaaaacccctacacangggcttcatttccagtgcccacgtcattggcttttgcagactatctt

SEQ ID NO: 1663 - DNA, 698 bp, Homo sapiens
  misc_feature (1)...(698): n = A,T,C or G
attcanatacaagctacttgttctttttgcaggatcccatcgattcgaattcggcacgagatttccctttgccctgccactttcaccatagggccttcttacctggcagaggagtgccttagataccagaagattggcagggaagaagggcagccacttcctggttaccatggagaagcttgtcatgctccaagcctgtgcttacttgtccagtagcaacaatgggaaactgtattatttggggtaggggtagaaccctgagggcataaagctaagaattccaggctgcatctggcagaatcggtttggcaggggttcagctgctccctgggaggccttggcatagccaggctgctccagcactgtgagctgggagtctcctcttgcagaagatgggtgtgaacctgacacgcagcaacaaggagacggtgaagcacagcgacgtcctgtttctggctgtgaagccacatatcatccccttcatcctggatgagattggggccgacgtgcaagccagacacatcgtggtctcctgtgcngctggtgtcaccatcagctctgtggaagaagaagcttgatggcattccagccagcccccaaagtgattcgcttgcattgaccaacacacctgtnggtagtgcaaggaaggcgcttcagtgtaccccacgggcacccatgccctggtgggangatgggcn

SEQ ID NO: 1664 - DNA, 760 bp, Homo sapiens
  misc_feature (1)...(760): n = A,T,C or G
ttgaaatncananacaagctacttgttctttttgcagggatcccatcgattcgaattcggcacgagcttgtgttttcttaactcccccagtaatagacctaactgattttgttttgagaagttcggtattagcttaagtttttgttcgtttatagaatatcaaaatggtatcaaaactgtttaaaaggtcaatgtacatctgtagcagagctttttactcttttccttgtcttctttctctttgtgtatatacattgtttatagttgtattcagtatacatgaaattttgtgtcttttttactcctctctgtataaactttctgtgctgcaacaatgtaaattacattcaggttgtttccagttttttttttactctgctgtagcgaacaaaaaaacaaaaattagccaggcgttatgccatgtgcctgttaatcccaggtacttgggaggctgaggcgggtggatcatgaggtcaggagacaagaccattctggctaacacnggtgaaaccccgtctctactnaaaaatacaaaaaccaaaattttagcccgggntatgggtggggggggccaccttnttagncccccancttacctcaaggaanggcttgaagggccggggaanaaatggggcattgaaacccccggggaccgttgggaanccttggccaaatggaagcccgaanaaatccgcgncccacntggcaccttcccaagccctggaaccgaacaggaaatggaaaacctggcantctttca

SEQ ID NO: 1665 - DNA, 689 bp, Homo sapiens
  misc_feature (1)...(689): n = A,T,C or G
attcanatacagctacttgttctttttgcaggatccctcgattcgaattcggcacgagctgttcactggcacacaatcacagtgtcttgatagtttttctggttttgaatttctggaagggaaatcctccttctgaggagacttcactttccgtcagtaatggggaaaactgtttccctcgggatagcagaggtcattttaaaagagaacactcagcagaaatgaaaatccaaacaactgatttttaattcgtgtctctttgttcagtgatgttggtcctgattctgcctatgagacgggaataaagagagatttcgggaaaagtgtgaagccaaacatgggtgctatttaaataccaccctcataatttgaaaaacttacctactggggactgtgctcactacctgggtgacaggatcatacgtaccccaaacctcaacatcacacagtatactcagctaacaaacctgcccatgtgtttcctgaatctaaaataaaaatcgaaataatttttttaaaaaagaaaaagacaatagtattacccatgggacaaaatttgtactattagcaagaatcattttgtgtctcatttagaaacaatttggacttttgttccagtgtttaaactttgacaaaaatggttttgaatagatctttataacctggatgccataaataccaagattctc

SEQ ID NO: 1666 - DNA, 686 bp, Homo sapiens
  misc_feature (1)...(686): n = A,T,C or G
tacnatacanctacttgttctttttgcaggatcccatcgattcgaattcggcacgagtataagattactttcatgttggatagtgctgctatgataacagtacatactccaaggagaggattaatagacgtaaagcctcttggtgttatatggggaaagttttcggagttttacagcaagaaaaacaccattatgtttgatgacatagggagaaattttctaatgaacccacagaatggactaaagataaggccttttatgaaagcgcacctaaatcgtgataaagacaaagaacttttaaaattaactcagtacctcaaggagatagcaaaattagatgactttttggatctaaatcacaaatattgggaaagatatctctcaaagaagcaaggacagtagttacaagttatactggcagttattgaagatacttaagatccaagaacttcttgcttttatgctagaaatcattatgatagtgctggacactgaagcaaataccatactgcttatacttggtcttccagttttttgtaaatttaattttatattttttgaagatgatagcaatatgctaaaaaatgcttgtcccctatatgaatattctgttacgcttggaaaaatattttctncagcgttgggttactgaccaccccaccttccaccacacacacacacacact

SEQ ID NO: 1667 - DNA, 684 bp, Homo sapiens
  misc_feature (1)...(684): n = A,T,C or G
canatacaactacttgttctttttgcaggatcccatcgattcgaattcggcacgaggcactgtcatgtctctagctgggaaatacacattgaacaactggttggcaacggtaacgttgggccaggcgggcatgcacgcaacatactaccacaaagccagtgaccagctgcaggtgggtgtggagtttgaggccagcacaaggatgcaggacaccagcgtctccttcgggtaccagctggacctgcccaaggccaacctcctcttcaaaggctctgtggatagcaactggatcgtgggtgccacgctggagaagaagctcccacccctgcccctgacactggcccttggggccttcctgaatcaccgcaagaacaagtttcagtgtggctttggcctcaccatcggctgagccctcctggcccccgccttccacgcccttccgattccacctccacctccacctccccctgccacagaggggagacctgagcccccctcccttccctccccccttgggggtcggggggggacattggaaaggagggaccccgccaccccagcagctgaggaggggattctggaactgaatggcgcttcgggattctgagtagcagggggcagcatgcccatgggcctggggtccccgggagggattccggaattgaggggcacgcaggaatctgg

SEQ ID NO: 1668 - DNA, 696 bp, Homo sapiens
  misc_feature (1)...(696): n = A,T,C or G
canatacaagctacttgttctttttgcaggatcccatcgattcgaattcggcacgagcagcaactcaggaggctgaggaaggagaatcacttgaacccgggaggtggaggttgcagtgagccgagatcgccccactgtactccagcctgggtgacagagcaagactctgtctcaaaaaaaaaaaaaatgccactggagagctttgaggagaggatcagtctggctactgggttgggaattaatcatagcaggcaaaggcaaaagaagtgaggttagttaggaggctttacaacaacccagatgagagatgggaggttttagccagggagatggagatgttgagagagtagctggactcaggattgtgacagtggactgaaggaaaagcaggttttgggggaagattgcatttctcccttcaacttcagttacgtagatcacccatatgccacacaactgcaactctgtaacagccaatttttagcttcttccttatctaagccatcctgtaggccataggaattaaaactaggttggatcaaggaaaagtgaatgctagatccatacaaaactatttggatatttgcctttgtattttattggttttgaaattattttttaatgggttcaataaaactcttactngaacttncaaaaaaaaaaaaaaaaaaaaaaaaacttcgagcctnttananc

SEQ ID NO: 1669 - DNA, 856 bp, Homo sapiens
  misc_feature (1)...(856): n = A,T,C or G
tnattnnnnnaactnttgttctttttgcaggaccctcgattcgcgagccacaagctgcactgtgaacctgggcactccgcgccgatgccaccggcctgtgggtctctgaagggaccccccccaatcggactgccaaattctccggtttgccccgggatattatagaaaattatttgtatgaataatgaaaataaaacacacctcgtggcananaaaanannnnnnnnnnnnnnnnnnnnnnnnnnnnnnnnnnnnnnnnnnnnnnnnnnncctcgccctttaaaactatagngagtcntnttacgtaaatccaaacatgataanatncattgatgagtttggacaaaccacaactagaatgcagngaaaaaaatgctttatttggnaaatttgggagctattgctttatttgnaaccattataagntgcaataaacaagttaacaacaacaattgcnttcattttatgtttcaggttcagggggaggtgtggaaggtttttnaattcgnggccgcggcnccaatgcattgggcccggtncccactttttnttccctttaatgagggttaatttgcnccccttgggcgnaatcatgggncataactgtttcctggggngaaaatttgttnttccccttcanaatttcccccaaaaaanaataccnaaacccggggaaaccttnaaaagtggtaaaaanccctgggggggggncccttaaatggaggnggaancctnaacctcnacaatttaaatttgggggtttgggcccttnaaattggnccccgttttttccnanancnggggaaaaaacccttttttngggnccccaantttggannttnaaaannaaatccgn

SEQ ID NO: 1670 - DNA, 802 bp, Homo sapiens
  misc_feature (1)...(802): n = A,T,C or G
gcntttgaatncatatacaagctacttgttctttttgcaggatcccattcngattcgtcttggcccatgtgggtgaaacttctgcttttactaaaattgcaaaaattanccggtgttggtggcacatgactgtatcccactactcaggagactgagcaggagaatcactcaacctgggaggtggaggttgtagtgagctgagatcgggccattgcactccagcctagctacagagcgaaagtgtctcaaaaaataaatacataaatagagacggggtcttactgtgttgcccagactggtctcaaatttctggactcaaagtagtcctctaacctcgtcctcccaaagtactgggattacagtcatgggccactgcacccggcctatattcactgtagttatttaaaaatataagccgggcatggtgtctcacgcctgtaatcccagcactttgggaggccaangcgggcaaatcacctgaggtcgggagtttganaccagcctggccaacatggtgcaaccccgtcttttaccaaaaaatacaaaaaattacccagccgtggtggcgtgcncctgtaattccaagcttccccaagaaggcttgangcaggaaaaatcgcttggaaccccggtgggcaaaaagcttgcnanttancccaanaattacgccccacttgcacttccaanccttaaggtggacaanaancaangaactnnttttcaaaaaaaaaaaaaaaaaaaaaaaactncgnngcccttttaaaaattattngggnaggnnngnattnaccttnanatcccg

SEQ ID NO: 1671 - DNA, 988 bp, Homo sapiens
  misc_feature (1)...(988): n = A,T,C or G
tttgnannnnnnagggnttggatcccttgcaggacccatcnntncggccnnattancctncntggtgctttctgtgngctttcnggttcncgnancctcgcttttttgnatgtccngggntgggcctgccccngagggccnacngnnatnnggncncnatttatttnttgnnnanccantatcttgnnccnacagntgcttttacagtctatntnnttcgcgcnnngngcgtatnagccncncttnttaccngggganttnctcnnccncnnnntnttgtttcntntntnttcccccnnttggggggaaganangggnnngcnnncaaaggnntngtnacnacaagnncttgnactcccgtacnnacggggaccgcccccgttgggaagaccttttncnnnnncgcataanaggctncnnctggatcggttactctcctngtcncacttgncgnctcaaaccgtcattgggcntgttggatcacctnctnnaacganccataaananaaacccccgggggnnnnaatacctgctngngnatngtangnntcncagcncntttaacntnccntctgaaggaangattnaagggancgggcaatccttgttnagngggnttnntngccttggggggcaanccaagggccaccttgntntnnttccttcaccgccnntggggccnntttccgaatggccgggnngtngggntcnggatncntcccnangcttggnctagncattaanncccanncccancnngntgcccctnttntaancatantcnccnttcttganngggnanntttgccttanctangcctnnnnccccgtannagtttcaaacnntnatgangnaaacctcggtagtnnaanctngtgngttnctcttccttngngtgccantcnggggannntccatcangtcgctgtnntcnnnantacttgnaanangggnatggnttcaanttnagggangccaanngtnann

SEQ ID NO: 1672 - DNA, 801 bp, Homo sapiens
  misc_feature (1)...(801): n = A,T,C or G
gttgantacaaatacaagctacttgttctttttgcaggatcccatcgattcgaattcggcacgaggtgacttccaagccccccgtcctggcagcgaggagggccctggacgctctttccacaccggtcaagtcaacaagagaaaacagggaancaaanggaacaggcatcatcaaactccagtttggaaatctgtcttcatcaaaatccaaacaggcatccttaattccagcagcaagcttacagcccaacatgaactccagtgacccagacctggctgtggtcaaacccacccggcccaactcactccccccgaatccaagcccaacttcacccctctcgccatcttggcccatgttctcggcgccatccagccctatgcccacctcatccacgtccagcgactcatcccccgtcaggtctgttgcagggtttgtttggttttctgttgctgccgttgttctctcattggctcggtcctctcttcatgcagtgttcagcctcctcgtcaactttgttccctgccatccaaacctgcacttgctttttgacaggccagaagaagcggtacatgaagactccagcacaccgttccggaaggcaaaaagccttgtattgcctgcaaaagctgaacatgacttaanaactttcgttcacaagcaggcaccggtcttcgataatgcaagaagtggtccttcaagctttncaaaaggccattctttaactggccacaaccgnaagctttcngggcacctttcaacctttttaaacttggggcacttttccactggggccggnctgg

SEQ ID NO: 1673 - DNA, 1207 bp, Homo sapiens
  misc_feature (1)...(1207): n = A,T,C or G
ttgaancntnanctcttgttctttttgcaggaccctcgattcgaattcggcacgagtcaggctgggaggggcttcttttttttggtgggggagaaccantnccacatacccagtaggtaataaggtgtcctgcnnnnggtgaangtcngcnagntaannnggggccgtctcnngggcccggngacgaacacgggggnccntttgttnnnngggggnggggggggggngnantttnancnnncnggggggttngggaattttanaaaaaatattacttggtnttttcaanaacacttccagcctttcttggatcctggaagttattaagggntngnaaatttnggattgggnanggggggccantangcccttanggtngnaagaaacaaggaagccttcggcccntttcccttacccaangggggaaggggaannaaaatgggtttngcccaaaaaacccccggtttttttttccccccctttttnnccccaaaanccccttgggggggaanccttaatttanttggaaatttttttcctttttaanccccccccccccaanggggggaaattttaanttggnaatttangganaaaaaanttaanttgggnaaaaggcccccccaaccccccaaaaaggttncctttaaagaaaaccnttttgggnaattngggggtngggttttttccnaaaagngaaaaantttaaaaaannttcaaattttaccccttgggaaattttgggccccctttccccccctttaaaggttncccccntttggggtncccccaaagnccntttnaaacccttccnaaagnccttngggtnttttaaattaaaaaattttgggaaaaagggggggaanttttccaaaacccnaaaaaaaattttanttcnttcnttnaancccanttccaaggggtggccnttaagnaaccaattggggnttaaggaaaatccttccaccccattgggtttttaaatnggacttgggttaagaataagccttantttaaggtgagggtagggaataaaatnaaaatggaatgcctaanaaggccaaccanggtctaagggtttaaagggattnaaggnctggggnaattggaatctcaccatggcttcccttnctttncttggggcctggaccactgangacaatgcggctatacaanaaggccatggcngtcantngccacaaaaaag

SEQ ID NO: 1674 - DNA, 1006 bp, Homo sapiens
  misc_feature (1)...(1006): n = A,T,C or G
gtttgactnccgtatacaagctacttgttctttttgcaggatcccatcgattcgattgtgcacctctaacccctcttctagcacccttaattgataccattcaagtgccaataattcttccaaaccagggttgagggacttttgaatttgctgagaaatgaaattctgcatatctttgcttgtcactaatgcctgtctgctctctgcctcaccttcttgtccattggtatatgtttggcactctgagagtatcagcatcaattcattcatatctccaatactctttcattaagtctcaggttgcttgccagcacagacaaggtactgcccaaagaagttctttggnaaacagncaagatntttactataccacnaanaaccttaacattcttntttntgaancttattaacaantttnnaaaatttananancnntttntnntnttcttncccnagnngncctttttntntatnntnnntttttcnnttttatnttntntntncatcttccnnttttnntcntannntatctannnttcattctcctttcnccttttntntnntnnttnntnatctnnntncnattncnnttntannnntctctttacnantnntnttnnncctcntcntnnantanncnccnnntatctncnannnnnncccnttnntnntntnttntnttctctctatnacnnnannatcntnctcttctcccnntngntacanttnccccctnnaccncctntntcttttacncccnannaaannanaaacctctaccttgcgggngggatggnccactatccctcnngngnttttnttttaataaccaacancctnttttggtcccnctnttnnanaaagggggacncaagnnaatnncctttccaaaaancctcaaatttggggnaatnggnctttntcncatttcctttttttaaaaaaaaaccanaaaaacccnttttggggtctcnttttntgtaaaaaaaacccccanccccangcc

SEQ ID NO: 1675 - DNA, 1078 bp, Homo sapiens
  misc_feature (1)...(1078): n = A,T,C or G
tnnnnnncnnnntnnnnnnntnnnatcnnnntnnnnnnannnnnnncacnnannnnnnagggngnggccnntttgganntgnnaccttttgnactcntgcagnncccagnaancgaanntgngacgaggcncttntcatcaccagcgcgggagnntgctgtgaactttttnaaccgggtgactgncatgcatgaagagcccctgcccacacatttcnccttcntttatggatgccngccagggntnggagcatggctggggaaggngctggccncnccngcntgtncagntactacagtcnnggatcagnannaacntggntgtgntnggagcagcantacanaanaancctggacctgcacactaatgccnctgcacaacnttcttggaanaaaaacnctgcttgngggaagncaanaggacnntnngctctntcttacttttgcagcctnncttgccgggggcacagaatttggcctnttatncatcaangagcnantaggntagtcntggatttcccangacacgggntaacccaggggaaaaanggtttggggnttgggcccatatcccntgggaaagngaatttcttttgctcccctaaagcaanatatatacncggggngttttngggnatatttccaantaagtaanccccantccangttcacgnaaggggcnctttggggntaaaggccaataaaagggggnaccctctaaaccattggtcacttgnggnatgggggncaantccccctangggctttatcttnanggngcccacgnannccttgnaaacaaagggaanggaggggnaangacgcantgaagggntttgaaagttgtccccggaanttggcnanccaggtatngaaccnttgcactaggnagcctatgggcnaaattggccaggnttnttccanacgaanggaggcnnnaaaacntttganccaannnaaatttnttctttgggtgaagaangaanangatgancatgacggccttgnttgnggggncanaagcangaaanaactttanntntncccaaanaancagngcnttgggggcggaaannnnn

SEQ ID NO: 1676 - DNA, 758 bp, Homo sapiens
  misc_feature (1)...(758): n = A,T,C or G
gttgatnngntcaagctcttgttctttttgcaggatccctcgattcgaatcggcacgagctgcaaagaaanggaagattttcttttttacaacctagattttagttttagagganggaaatagcttgaaaaactaaattgctttggtgaaatgtcctgtacagaacagtaccttggcattcagcagctgtaattggggaacattaaaacagtaactgacatccagttaaagccacgatcgtcagcaattctccttttttaatttctgatatttaaagtttttttccagtctacaccaggcctctccaaggagacagttcattatttaggagtgaatgtgttcctcttgcaatattatcagtacctgcatgacttggtaaattcattttataaaaatagtgtttttttttttaatttcagttcattgactctataactgcagaaattagataatgttttataaaataaatttgccacataatatgggatgcaataaccaacaaagctgctaagtgccaaactgttattttactatatataaatattaaaatattgtgttgaagtatagggatgtatttaattttactatgctcccaacattaatcatggactcttttgtaaattacagttatttcagtattgtaaaataaatgttggactcatttcaaaaaaaaaaaaaaaaaaaaaaaaccncngcctctaaaaacttttgggagtcgtttttacntagaatcnnacatggataagaaacatttggng

SEQ ID NO: 1677 - DNA, 779 bp, Homo sapiens
  misc_feature (1)...(779): n = A,T,C or G
ttaccgcttttgttctttttgcngatccctctttcgattagggctgctgtgatattgtcagcttgcattaacaattagaagatagagaacccgccatcagggtgtctacctaacttctcagggactacacttggtagttttccccctttnaagaactggtnnattgaaacatttgtggggttccngaattgcctttacagggtttttttncttttactggtttgctctggggtnttataatatattgnttgactggctggtattatcgaactagtagcaataattatatgtaaaaatggccaagcatataaggtaaacttatataagtaccctaccttatctgnatttcaatttttttaaactgcttttccaaatatgagactatgttaaagacactaaaaaaaaaaaaaaaaaactcgagcctctagaactataggagtcgtattacgtagatccagacatgataagatacattgatgagtttggacaaaccacaactagaatgcaggngaaaaaaatgctttatttgnggaaatttgggatgctattgctttatttggaacccattataagcctgcaataaacaaggtttaccaccancaattgcctttcatttttatggtttcanggttcaaggggggaaggtggttgggaaggntttttttaaatttcggngggccggngggggcccaatggcatttggggccccgggnnccccaaccttttnggttccccttttaaggggagggggttnaattggcgcccccttngggggtaan

SEQ ID NO: 1678 - DNA, 1079 bp, Homo sapiens
  misc_feature (1)...(1079): n = A,T,C or G
gnnnnnnnnnannnanannnnnnnnngnaannnannnnnnnnnngnnannnnnnnnnnannngnnaannnaaanannncgnngncnnnnantannnnnnncnncccgngnnaannnaaggngnnnncccnnnntttttttngggaaaaacccctnnnnnnnngnccnatntttntcgggngaacagcctcctntgggcangggnaaaccccccataccgttggngtaanaaanaaacncccnncgggnccaaccggcaaagggccaaccaaccaaccaaccggncnanccnaccatgttaccccgcaanattntggtaacnaggnaacntcaaacnatttactaccaccaggaaccatnggatgggaacaaacctanaaaaagcctnggggnacttcttnccncntcctgtatnggnnggaattattngtnggggggngtcanaanaaaaangtgctnggggcncaagaggcnagnggtttganangtnntaccnnccagaatnggantgggaaatgnnggccccctccaaaaanananncagngcatggcnagagacagccattaatgcacgagaatactacctaggagctctgnctcacangaagcggnggggctgnaaacagcccttgcaggaggcttgncctgcacgcnantngatcggccttgacattggtcaacanngcccnccncttgtggttcccaggcctnccaacatcttctcaangcnctcataaggcactatgtgangagctntgagagganatacaattnncttaggggcgggagcccttananccanaantnccangngatggtaancccccatttangtaatgncctctatgtgnagccccaggcnntggggatgnaaaaaaaccatctaccagggggccaacccactngnntcntaaanccaaaccccnncttngggaaaataangggaaannccttccggttanccnnggnantaggtgaaaananacccaaccnggggcctncanggnacncgncaacnnaaggggngnggaanngaaaacacgggcgaacgggggggtcgnngnngggccccatccnnnn

SEQ ID NO: 1679 - DNA, 1035 bp, Homo sapiens
  misc_feature (1)...(1035): n = A,T,C or G
ttntttnncccnnnnnnnnnnnacgganccctttaaccctttttggggtttttnccttttttttttttgggcccaanggggnantaccccccccntttcccggnantttttcccggnaaaatttttcccggggcccaacccggnaagtttaaaanggggggggaatttttttgggttggggggcccatttancccccatttccaaaaaggccccccaaaaccccccattttatttacccacccatttttattgggggaaaaanggttttccaccaaaagggaaanggaaaagaaggaaggaaaaagggggaaattggggggncccgnaaaangtttttactttaaaatttnggttgggncccccccaaacttttcccccnatatnggggaaangaaaatgggnctttcccgnttttccnggaagatttnaggggncccccnttnggntnanctttnacnccccccccgacncntttttttaaaattgtccnctctcaaagacagtagagaattttgaaacaagaaaaaagtgcttgcgtgtctagggaccacatcagactatcacatattctcacagaaacctgtaggcagaagggagtggagggatatatcaaaggccaattaactgatctttgcaagattgcaggaatcacacagaaaaaggtagtcttcaataactgtgttggaaaaactggatatcacatgcaaaagaatgatatgggacccttatcttatccatncncannnnanannnnnnnnnnnnnnnnnnnnnnnnnnnnncccncctnttaaaactntagngnggtccgtntttncgttagatccngccntgataagaatnccnttggatggagtttggnnccaacccncaccttaggaatgcccgtggnaaaaaaaatggccttttnttttggggnaaaattttggggaangccttttnggcttttantttggtaaaccnnttttttaagctggccaatnaaacaaggntttaacccanccanccaanttggccntttccantttttattggtn

SEQ ID NO: 1680 - DNA, 781 bp, Homo sapiens
  misc_feature (1)...(781): n = A,T,C or G
agnttgactncntatacaagctacttgttctttttgcaggatccctcgattcgaattcngcacgagggacattatatgtctggaattttcacagtaccctttaattaaagagatatcnttaattaaagtagctctggtgaacagcaaggaagtgggatgaggaaacagaaattggcagagtccatgatttggtccagattaaactgccatgagtgactgtaacaaaaattcagaacttatgtaactcaaataggtatatttgagaaataggtcggcacaggtcaagatgtgaaagcccaataaagctaggcagagacttggtaagataaaaaaaaagtgcctcaaaatgttcagtgacagtagtgccctgatacaggcagtacttaaggaaaaatcagtatttaagggaagagctgtaaagggtctccaggagtgggcaaagtatgtttttaattaaacattttattttgagatgattgtatattgatctgcagttgtaaagaaataatagagttccagtgtcccctttcctgttttcttccaatggtagcattgtgcaaaactatggccaatatcacaccaggacattaatgttgatgtagtcaatatgtagaacatttncattcccccaaggntcccccagtgctgctcttttttattccacaggtcaccttaccccaccctcatttctttaaccctnttggcnacccattnaatctggcctcccntttcttaccaattttggnattgggaaataatgggtattntcaattgggaatcn

SEQ ID NO: 1681 - DNA, 756 bp, Homo sapiens
  misc_feature (1)...(756): n = A,T,C or G
agnttnactacanatacanctacttgttctttttgcaggatcccatcgattcgaattccgcccgagaagaatgggggtaatctggatggtatagtttttagggggtgaaatttagctgtttaaatcataggctgttgacatttgtgattacttcattgctaagttttacatataagagtcttcatactttgtttcagggacagaatgatgctgctgaaattggaacaagaaattttagatttcattggtaataatgagtaagtcctgacattcaacaagaaaagaaattgtcatcaccattctccttgacttactaagttggtttttcttgtgcttctaggtctccacgtaaaaaattccccccaatgacatcttaccataggatgctattacacagagtagccgcttactttggattagaccacaatgttgatcagagtgggaagtctgtcatagtaaacaaaactagcaatacaagaatgtaagtgtcaagagatgtaactacatattatatatctaaataataatactttatctttctatattacctttcatctgagggtttcccatgttttaacagtctaattaaagttttatgataaccttatgtgataggactgaaaaacacatttagtttactgggaaccaaaatgcaacagcctggactcaaatttggcatatgaatgangactggggcatatngtaaaaaaaataaaaaatnccgangacatagtatcagtggtggtttggacancc

SEQ ID NO: 1682 - DNA, 841 bp, Homo sapiens
  misc_feature (1)...(841): n = A,T,C or G
ttctatnnnnctacttgttctttttgcaggatcccatcgattcgaattcggcangaggnactntncatnaccaggcgcnnnagttggctgcnaactngcngnaccgngngtttgncntcnatgaantgccnncgcccagatncttcaccttcctnatngatgcctgccnaggactggaacntgctcnnaangtnctngnctacccctgcgtntacagtttttacngncatgacccaaagtacattgatgnggtngagnactnganagagaacctgnactgcacancaatgccctgcagatcctnctggagnaaaccctgctgcggtgcanagacctgctctcctgcctgcgnntcctgnangccgactgncttacacnggcttngatctggtcctggggatacaaganagctgctngcnatcnttgctttattatncccaanattncnggntttggttttcncagtccatnaaatntatgcctgggaggctaaatgacccnacatgctntggcanttagccccnggncttcctcagggccatnagctgaagaaggnaggnnggaataccnttacngatnatgtgccncgantggntagcnntgntnatttttgattgaaggancttggaccaatttacngctttttcnttncggatgaaggatttgaaaaactttngtacnaanaataacttttcntttttttgccgaatgaagggaaanaatgnttcaaattanttaanggccttatantntgnanngngggcttnttgccccgnaacatccctntaaacnaggccccnaannttntcgggggntttanggggggttggnaacctgccnn

SEQ ID NO: 1683 - DNA, 739 bp, Homo sapiens
  misc_feature (1)...(739): n = A,T,C or G
gtnacacaataaagctcttgtcttttgaggatccatcgatcgaattcgcacaagaactgtccccgttattntgtccatacagcaccagccccaatgggccctgaccacctccttccccagcagaaacgccccttcgtgggtgttgaaaatactttctattctgggtcaagcaccaagaatgcctttttcccttctgcaggtcctccagtgattccccttaagaatgcccctttcaaagccacccccccatcgcagcggcacagctccctctagagttccttcacactcacatcctctcccgcctcaggtagaaatatccgcctgcttagctccaggctcccatgacatactcccgtacctcctctcaccccaccctcatcgcggtcagcccgtcttcattacttctgccacagaacagtgtcccgcagtgaggcggtgaagccttccttcccagaatgtgcctcatcctcttcctatggcgtgaacaactgttgccctgacctgcagcttctcacccagctctcaggctatcgtcctggactccctagggaagaccctggacttcactagggtgtgacttcttttctcgtaggcattccttctgcgttgaacgcatattcactattctagctgaagggtataatatacagccacgaagggggtcgatacacacagtgtctcctgngcngggtctcacagtctanttgatcagacaccantcgacaaagatcacggggtt

SEQ ID NO: 1684 - DNA, 1201 bp, Homo sapiens
  misc_feature (1)...(1201): n = A,T,C or G
ttnctcccgctttggtctcntcatcgcngnaatnccgnctgtcttngggcccggcngntgctcccgcgcccttgttatctgggtctcctgaatcttctgnttttggccccagtttaaangattcatccccggncngggggttttnnttttttnccnttggggggggnttncccccttccccggggggtggnttnnnggnnctttccngggccctccccnggcnacccaggaagaatcccccttcctttgggggnggttttttcaaagttaccccaccaatnggggggaagaaatnaaaaagggggggttttttgggaaanccattggaaaaaatngganccnaaaaaaacccaancccangcccaaangggaaaaggnaaaaaaaaaagttcccnttngggtcccccctttttttttttccaantttnancctttaanttccaangnaacccttccaaaaaaattaaaaaaatngggttccntttgggggggcctttcctttttnaanccaanttttnanccnaattttcccaanttttcccttttncnaaaacccccaantttnggggngggggggtnccctngggggccctttttcccccaaccttttnccccntttttcnaccntttttcnancccccnaaaaccaanttggggggcctttccttngggcccccnaaaaaangggggaaaaagncccccccggggggggnaatcccctncttttaanggggncccccattccaaccnttttttaaaaattnggggaaanccttccttcntttaanccaaaaccaatttttnaatnccccnggggggtttggggttttaaaaaagnccccccttcccntttaaccaaaanccaaatttgcctttccctccttccttttnggggttttttttaaataaagggcctncccaattctttcttnccctnggcttttccttttnaaaccttnggaatnaaatnggccaatnacctttgggaatttttttcctnaatttngggttaaattttcaatnaaaaccccaatttttaantnccccccgggattaaaaaatggacctgggtntttatccaaaaccattggttttggtatttagaaaaaaaangggatttttggggaaggccctcttcaatatggtnaaattaaggtnctatttaaaccatanttnaaatggngaaaaaaaaaaaaaaaaa

SEQ ID NO: 1685 - DNA, 752 bp, Homo sapiens
  misc_feature (1)...(752): n = A,T,C or G
ngnttganttcgatacagctcttttctttttgcaggaccctcgattccnattccggcccgaggncggaatcncattgggatccagccttttcctcttatgaatgggtctaccgccaggtgacgctcaattgcacgaagcttaaccttattcataagaggaaaagacagaattcacattgggatccagtttctttaatatctcatgcacttaaacagaaatttgcatttcaagaagatgattcttttgagaaagagaatagatcttgggaatcttccccattttctagtccagaaacttcaaggtttggacatcacatttcacagtcagaaggacagcgaactaaagaagaaatggtcaacacaaaagctgttgaccaaggtatcagcaacacaagccttctaaactcaaggatttaaactcaacttaaggntgagctttaaacttccaaaacttcttcctggatgataaattattcttagaaactgatttggactgttaaaggctaaaagtagatgtatttaaagactcttcttgacacattttgcctacacttgctatgtaaatatgtatgcctgncatttttggttcctttggtcctttttacgtttatactctggtcttctgtcatagagcttaaaataaacattcttttttgnacttggaaaaaaaaaaaaaaaaaaaaaactcgagcctnttaaactatagtggggccgtnttncgtngaancngacctggataagatccttggtga

SEQ ID NO: 1686 - DNA, 733 bp, Homo sapiens
  misc_feature (1)...(733): n = A,T,C or G
ntttgatncgttctnctcttgttctttttgcaggatcccatcgattccgggaaatatcctcaccttaaatccttatctggccgttactcagggatatactaggaattattgtcatcaattatcttcaataatagcatttttggtcaaattaaatgagtggtaagcttcttcacaatgtgaccattgaaattgaatggtttgttctgtacctttttgcttcagcaatcaattttctccattaagatgggacttgtactttaattcagatatggtacctcccgaatagaaaataaattatgttaatatagttgtaataataagtgtgtgttaagatttggttactataaactactgatttgttaaaacttgaggaaattaccataaaatgtctactgaatcaatttttcctgcatttagtcttaatgtcaattctgtcatttcctctttcattaagaaaaatagcagtggccaggcatggtggctcacgcctgtaatcctagcactttgggaggccaaggcaggtggattgcttgacccaagagtttgagactagcctggnccacatgggaaaccctgtctttatnaaaaatataaaaattggncangtgtngtggcaccacctgtggnccacttcttgggangctgagcaggaagatcgcttgagttcaaaanttcagctgcaatgagccgaatcctgccntgcactccancttggacaantgagacttgcncn

SEQ ID NO: 1687 - DNA, 740 bp, Homo sapiens
  misc_feature (1)...(740): n = A,T,C or G
agtgnttgatctnctcttgtcttttgcggatccctcgttcgtctattgattacatgagtctactttataaactggtataggctatgtaattagcccgtaagttacttaaaggaccaggggacctaatttttgtcagttttccagtcacattggtgccattcaggactccagctgtttacaggaaatatgtacttagcagaatagtatttttccttgaaaaaaatttgaattcagcctaaatacagaatgaatatgaatagtttgtgaaaagggttagagaacaacaatattcctatagtttctgtattaatgcagtagagacagaggttcctaacgcaaaaagaaaaccacaagtaaagaccgtcaaattagagctttagaatatgacttgaaaaagtagggatgggcaaaacagcataagaaaatattttttcttaatgcagatggacagtgttttcttgttttaaaaatgttttgcctatttgccagcattttttgaagtaatacactgctgctcctggaagatgtctaacttcattttctacaactcttatgtgattttgccattgtcattaagatgcattgattttatttatgangtgtatgactttaaatatctaaatgctgtattaagtgacttgtttcaaanggaattaaatgaagtgaaaaccgtaaaaaaaaaaaaaaaaaaactcgagccctttanaactatagtgaggtcgtnttacgtaaaatccaga

SEQ ID NO: 1688 - DNA, 787 bp, Homo sapiens
  misc_feature (1)...(787): n = A,T,C or G
gtnattaataaactattgtctttttgcaggatccatcgattcgaattcgggacgaggccangctgtctgcggatgctcctgctgctctggttcaaggctggcctccagacttcaccccctatcgttccactggacagagagacccaggcacagcccccggatggtgaccacagccctggcaaccatgagcagtcctacgtggggaagcggtcaaaccgggtggtgcgaaccctccagaacacgccgtccctgcactccaggcactggggagctccccagcagcgggagggacggcagcagcagcatcacgaggagctgagtgcgacccccacccccctggggctgcaggagaccatcgcagagtttttgtacattgcccggccgctgctgcacttgctcagcctgggcctgtggggtcagaggtcgtggaaaccctggctcttggctggtgttgtggacgtgaccagcctgaaccttctgagtgacagaaagggcctgacccggaaggancggcggganctgcggcgccngaccatcctgctgctctactacttgctgcgctctcctttctacgaccgcttcttcgangccaaggatcctntttcttgttncaattgcttggccgaccaaccttccttggcgnttnggccttggtcacnaagggccgcttcattgggatttacnttggcccaancttggccaaaaaaaaattntaactttnttacaagtttngggggcnttgaacaanaaacnttccccggaaaaaggaaagggttttttgggggaa

SEQ ID NO: 1689 - DNA, 744 bp, Homo sapiens
  misc_feature (1)...(744): n = A,T,C or G
agtttnatatagantacaactacttgttctttttgcaggatcccatcgattcgtccagtcgcaacggcccagaccttgaccttgccacttccgggcgtggggtgaaatctcttgattcctagtctctcgatatggcacctccgtcagtctttgccgaggttccgcagcccacctgtcctggtcttcaagctcactgccgacttcagggaggatccggacccccgcaaggtcaacctgggagtgggagcatatcgcacggatgactgccatccctgggttttgccagtagtgaagaaagtggagcagaagattgctaatgacaatagcctaaatcacgagtatctgccaatcctgggcctggctgagttccggagctgtgcttctcgtcttgcccttggggatgacagcccagcactcaaggagaacgggtaggaggtgtgcaatctttggggggaacaggtgcacttcgaattggagctgatttcttaacgcgttggtacaatggaacaaacaacaagaacacacctgtctatgtgtcctcaccaacctgggagaatcacaatgctgtgttttccgctgctggttttaaagacattcggtcctatcgctctgggatcananaananaagattggactccaggctttctgaatgatctggaaaatgcttctgagttcttcattggtgtccttcaccctgtgcacacaaccaactgggattgaccaacttcggacaatggaaacnn

SEQ ID NO: 1690 - DNA, 754 bp, Homo sapiens
  misc_feature (1)...(754): n = A,T,C or G
ngttatcgttcactcttgtctttgcagatccctcgattcgaattcgccgacagcaactcaggaggctgaggaatgagaatcacttgaacccgggaggtggaggttgcagtgagcccgagatcgccccactgtactccagcctgggtgacagagcaagactctgtctcaaaaaaaaaaaaaatgccactggagagctttgaggagaggatcagtctggctactgggttgggaattaatcatagcaggcaaaggcaaaagaagtgaggttagttaggaggctttacaacaacccagatgagagatgggaggttttagccagggagatggagatgttgagagagtagctggactcaggattgtgacagtggactgaaggaaaagcaggttttgggggaagattgcatttctcccttcaacttcagttacgtagatcacccatatgccacacaactgcaactctgtaacagccaatttttagcttcttccttatctaagccatcctgtaggccataggaattaaaactaggttggatcaaaggaaaagtgaatgctagatccatacaaaactattttggatatttgcctttgtattttattggtttgaaattatttttaatggttcaataaactcttactaagaacttcccaaaaaaaaaaaaaaaaaaaaacctcgagcccnttanaacttttagtgagtcctnttacnttaaatcccaaccttgatnagaatccatttgatgantttttggacaan

SEQ ID NO: 1691 - DNA, 830 bp, Homo sapiens
  misc_feature (1)...(830): n = A,T,C or G
attcnttnnanctattgttctttttgcagatcccatcgattcgattcggcacgaggctgagagaccccttgctgatgcagctctgatgtccccggntctggnagagnangncttttgtgngntgncnngttncgagtaccagtgacntggtggatttggaactgtatgccnaatggngttatccnnggnangtttgtctnntgtnggtanangcctnnaacncttanntgntgggtggaggaactnttttattnatttgtacntccgaggggncannganccctttanngaggtgntcangccacacncnaaaagntgngccnaganaaccgcgactgnntgnctttgctnctnatctgctgaanaaaaaccaccncttctnattgganttactcngagcttccaggataaagtgacatcggcaganancannntgctgntagatnganacatcagtggaggacttncantgngactttttnancctgtggaancnaaaacnaaagcttattaagntccttggccgaggcctttataanatnttaactttgnctctantgtatnttgggancntccttnaagctttcnagggggggccangatnnaactnntnnnttcntntaaattttnnaaangctngannnccttaatttagatggnaaaaaccnngnaannttggcccnantngnctttgcttccantcnggttngttaaaggctaatgnnccnnctaaagnccntananggttntatancttccctggtaccntntttgnaacccatangcctttnnttatnaaaaaagcttggtattanggnctcnttanannn

SEQ ID NO: 1692 - DNA, 1436 bp, Homo sapiens
  misc_feature (1)...(1436): n = A,T,C or G
gnngantgagnagngnngnaananaananaggnggnnncggngangannannnnnnannnggngncgnnnnnnnnttttgggaaacccttaaannagntcccaangagcnngntgagtanangacnnnngaacacaaganngagngnntnngnagtgaangngggngganngaagtgaaanttnttngggnagnccngnntgnccnnggngagtannggancgntnnggananngnnnaanntnngtaanaanggactaanaangngntgnaannggannncggangngngagnagagantgantaanngnggnggaacnggatgcggagtnnccaacanantattaacngnntnngggcgcgggangngggncagaagnganntggtnctannagagggcgtaatgangnggagnnnntgnnananagcgnggaggggnaannangtgggaatnngagnataggggactggganngggncngacaaannnnnnanannngggcgggcgngnanntgggnggaatntggngtaatgancnaaggtacagangaaaagaccngagtcgtaagcngangtggccgggtgatgtanaacnnatgaggtgggaccangnangtncgatgnggngnncggtnataacagaaggagcnnnatgggncangangatnnangataaagtngggagtatnnttnnagggggngacatantnttgaaggcacgaataanggngtagaangantgtcngcgnannagnatanggagggangcnggggngagncctgaaaggggtnnnngacgagngacgtggcngnagganannntaangnnacggtggnngcgcgagncgngncntganaagaanngnngcgacnngagagtgggnatagtgtagnaggaaagagagnggtagcgtnaacaganacgcngnnggatatgggggcgtcngngtcnagatancgacnatcnnngangnangagtggnnatcagtnantngnaacgatngagancganatagagngggcganactggaggggnanannggggnacgtgaagnntgacgnnggcatnnngctacacgnngcgcgggagaaggtgaaggggangannatgatgacgngnagagangnnaagagantangacagaacnagncagtagnagaagnagagacgtgacantgangtganngcgcantnngaacgcanactaatggacgantncataancnagatngcgtgncgggagnaaagaaggtgcngggaganggaangangaaatgggacgtaataagaagantagaaggggccannggaagagacatgngngngggaggnngnggatanaggncggggggcgngatggccgtngngaagnngnaatnactggggnggnaaananaggacncgcgncncggggaggggaaacaanagnga

SEQ ID NO: 1693 - DNA, 767 bp, Homo sapiens
  misc_feature (1)...(767): n = A,T,C or G
tntgaancctttggaactcntgttctttttgcaggatcccatcgattcgaattcggcacgagggtggctcatgcctgtagtcccanttattcaggaggctgaggcatgagaatcgcttgaacctgggagtagaggttgcagtgagctgaaattgcaccactgaactctagcctgggcaacagagtgagacttggtctcaaaaaaaattaaaaataaaaaataaattgggggctgagtgtggtggctcatgccttcaatctcagcctcccaagtagctgggattataagcatgcgccaccacgcctcgctaattttgtacttttagtagaggtggggtttcaccatgttggtcaggctggtttccaactcctgacctcaggtgatccgcctgcctcagcctcccaaagtgccagtattacagacgtgagcccgctgtgcctggccgagtaatttttttttaaaaaaaaagcctctagaactatagtgagtcgtattacgtagatccagacatgataagatacattgatgagtttggacaaaccacaactagaatgcagtgaaaaaaatgctttatttgtgaaatttgtgatgctattgctttatttgtaccattataagctgcaataaacaagttaacaacaacaattgcattcattttatgttcaagttcanggggangtgtgggaggtttttaattcgcggncgcggcgccatgctttgggcccgtnccaacttttgttccttttatganggttaattgccccctn

SEQ ID NO: 1694 - DNA, 779 bp, Homo sapiens
  misc_feature (1)...(779): n = A,T,C or G
nnnntttnnnatcctntacaactacttgttctttttgcaggatcccatcgattcgggagaattcccttattgctcacttctctgagcttcaaggttctgaagcatccagataagaagttccgggttggccaggccctgagggccaccgttgttggcccagattcctccaagaccctcttatgtctgtccctcacaggtcctcacaagcttgaggaaggggaatggccatgggccgagtggtgaaggtgactcccaacgaggggctgaccgtctccttcccctttgggaagataggaacagtcagtatatttcacatgagtgactcctactccgagacgcccctggaagacttcgtcccccagaaggttgtcagatgttacatcctgtccactgcagacaacgtattgactttgtcgctgcgatcatccagaacaaacccggagacgaaaagcaaagtagaagatccagagattaactccatccaggacattaaggaagggcagcttctgaggggctatgtagggtccatccagccacacggtgtgttctttcgccttggcccctccgttgtgggtttggctcggtactcccatgtctcccaacacagcccgtccaagaaagccctttataacaaacacctccttgaagggaactgctcacagccagggtcctacgccttaccaccagaagaacctggtagaactggctttncttcccggagacactgggnaagccagacgtgctttctgcttncttgggaagggcaacttacaaagcaa

SEQ ID NO: 1695 - DNA, 691 bp, Homo sapiens
  misc_feature (1)...(691): n = A,T,C or G
ctnatngatcactcttgtctttnagatccatcatcgaatcgcacagatgacatgaaatggtggccacaccntgtgctgctatcaagtgatggctgccagatctgggcngcccagacctatggatggctgcctcaggtgcagcatcactgcctggtttgatctgcctgtaaatcatccttagctgattgctgaacttgcattgtgattgcctgtagagttgctgagaggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatgggatcacaagatggaatttagcaaaccctanccttgcttggtaaaattttttttttttttttaaaaatatctgtaatgggtactgactttgcttgctttgaagtagctctttttttttttttgcagtaactgntttttaagtctctcgtagtggtaaagtatagtgaatctgctacacaatttctaattttaaaaattgagtatggtgtagaacactaataatcataatcactctaattaatggaatctgaataaaggnacaattgngtaccttttgtataaaataacaaatanaa

SEQ ID NO: 1696 - DNA, 774 bp, Homo sapiens
  misc_feature (1)...(774): n = A,T,C or G
cnctttacaaactcttgttctttttgcaggatcccttcgattcgaatttcggcacgagctgcattgtccactggacgttttagtcatattnngacaccagttgtttcctccactcccagacttaccacatctgagagaaactggcttgtgggngtcctccctggtccttatagaatggcccccgtgcttccnagtgtnctgnagctgnccgtcngatctctaacntacttcagtgcnggaaaaggcaagagaaagaccgtgaaagctgtcatcgataggtttcttcgacttcattgtggcctttgggtgaggagaaaggctggctataagaaaaaattatggaaaaagacacctgcaaggaagaagcgattgagggaatttgtattctgcaataaaacccagagtaaactcttagataaaatgacgacgtccttctggaagaggcgaaactggtacgttgatgatccttatcagaagtatcatgatcgaacaaacctgaaagtatagatcagaagtttcacttgtttctcagttattggatatgtatctttgtgtacatatctttgcaaaaatggataagtacaaaacttgatgtaaattgtccaatgaatatgtnaacatacnagtgacaacattaaacttagaaaagttttaaaacttaaaaaaaaaaaaaaaaaactcggcctctagactatagtgagtcgtattacgtagatccagacatgataagaatncattgatgagtttgggncaaaccacacctagnaatgcang

SEQ ID NO: 1697 - DNA, 1199 bp, Homo sapiens
  misc_feature (1)...(1199): n = A,T,C or G
tttttttagagagggnntttnttttgnttccntnnnnnnagagggggnnaatngtnnaagnnncgnnangtntgcgggnnnnnntnnctangtaccccgnnttcnccttatttnnttntganctgcgtnntttancttactttagtnaattnnttgnnggnngcnctttngtttttgggnatatttttgnaatatngcttntttttnatatctggtacgannntttgntttntntanntaattttttgctgttgantgtagnagnttcnctgtgtatatctnttcngnntnanncnttgcttcggcnttangtngnatttggtngtttgcatgtntnnagatanntatntttctngtcagggnanttgntgntgntgnttctgntctntntctnntgggggtttnnatntnagtcttgtattnntatnnctacacnttgggtgtatgnacatatatnnatgnntnanggtggtatnttantngatntcgtctctcggngtgnatatatagnnnagtgggtngncganntgngaaacgtanggntagcntangtnntcttttatncgtggnaanngtgttattgtttggcttactcnatntgtcctagangtgngnncatatggcccnatagtgggnagacctcaattcttanntactnggngataagtatngaatanggtgnggtanantgtnggnacantttgtgnntattttcaantnggtgngnnggtgtaangccncctttganttgtantnttcaatgcgngtgtatannctnggtncttctgatatnggggnattgggtanagctccnctgctgntgtgtatatngatggnggggggtcaccgtaatnttatngctntgtnnngcnccatgatggagnntggngtaattgnancgattttnttttgnatnttggatnngttgnganctcntggggtaggcacnttcatggctgcanntncnggggtanggangtgcnnangctctggggtntggnncgtgancncctagngtgggtaattggntcntnntttgattaccattnaatnaatagcatnggnttnngntatnattantgnnagaatggtgttnccttgatcntatatnttaantcnttnatttatnttgattgtntnnggganttatgcttntggtggnattgtcttntnnnagactnatatntntattgtattnn

SEQ ID NO: 1698 - DNA, 783 bp, Homo sapiens
  misc_feature (1)...(783): n = A,T,C or G
agntttnaaaatatcanatacaagctacttgttctttttgccaggnatcccattccgattcgaatttcggcaccgaaggaaacccgcccactttctttgggatcnttggganggtgggtggttaaanggnaacctcnaagtttttcaaanctttccaaattgctcacagcttgatcctaagggnttgaagccatcccttgtcaatatatttnggtnggtatcggtcaactggtgccatcattgccaatggggatcaccaaagcctgccgggagctagaactcaaggtgcccctggtggtccggcttgaaggaaccaacgtccaagaggcccagaagatactcaacaacagcggactccccattacttcagccattgacctggaggatgcagccaagaaggctgtggccagtgtggccaagaagtgatgtctttgtcctgatccaatggagaaagaaagccatttttccgtaaaaagggatggttcatcattgtgaaagaaatggttatctcattggggaagaaaaggggagggggaangcaagaatcacttgaaaaatcttaaatctgtgttttctggaataaagatatctagacagcctaaatctgattttggtctttatnaaaataatatcttgnggtctcatacttttctgtcactgtaagcctgccaataggcagtgttttgcaaacttttggggagtggtctatgtngcccaatatttgtgtgtatagacagaatttgaaatcaatctgttcnttacaanaatttggtgggcattaat

SEQ ID NO: 1699 - DNA, 792 bp, Homo sapiens
  misc_feature (1)...(792): n = A,T,C or G
tnannccttnaactcttgtctttttgcaggatcccatcgattcgaattcggcacgaggcactttccatcaccaggcgcgggagtntgctgtgaacttgcggaaccgggtgtntgccatccatgaagtgcccccgcccanatccttcaccttnctcaatgatgcctgccatggactggagcangctctgaaggtgctggcctacgcctgcgtgtacagnttctacagccaggacncagagtacatggatgtggtggagcagcanacanagaacctggagctgcacaccaatgccctgnagatcctcctggaggaaaccctgctgcggtgcanagacctggcctcctccctgcgcctctgcgggccgactgccttagcacgggcatggagctgctncggcggatccannagaggctgcttgccatcctgaancattctgcccaggatttccgggttggtcttcanagtccatcagtagaggcctgggaggcaaaaggacccancatgcctggcagtcagccccagccttctcanggccagaggcnnaataggaggaggaagacgatnacgatgatgtgcccgantggcancaggatgagtttgatgaggaactggacaatgacagcttcttctacgatgantctgaaaacctgtaccaaaaaactttcttcttttggnggatgaaggaaaaaaggatgaaaaatganggccttntgacttganggggcaacatgcaaggaaaacaacctaaaagcaagnccccaaanttcacnggggcttnangngggcgngaa

SEQ ID NO: 1700 - DNA, 769 bp, Homo sapiens
  misc_feature (1)...(769): n = A,T,C or G
agntttacttcgatactcctacttgttctttttgcaggatcccatcgattcgatttcngcacgagacatggngagttatgcntatctgaaattgaaagaaggcttgtttttaaagaggcttggagcaaactgcagcagtnctttccaaaggctcctgagtttccaagttncaaagagtggctggttcacagtgcaggattttagaaangagaaggggaagaaaatgaanccttacataagatgattgcaaacgaaccaaaagacttctctcccaaatttgttccaggataaaaacagaccgtgtctcagtaactggccagangatacggatgtcctctacatcgtgtctcagttcttttgtagaagagtggcgggaaatttgntagaaagcctacaagatgcagccctgtgtcatcagttggggaacagtgctcttttgtgtccccacnggggcctcatgtttacatttgcttccatgaccaaagaagattctaaactttatagctctcatatggcccaatgagtgggcaaatgatacaaaaagctctttggtgtggatcatgtaattnaaaatcacgagaattggaagtgggagatgtnaacccttcagaaacacagtatatttcttgagccccaactctgtccanaatgcnaaanaaggcttattgtgtcagcagcaganggacctgcttgaatcactcaagcccccatctattgtccatnaagttgtggatnattaaaaaggtgatgaaaggattccgcttccgaa

SEQ ID NO: 1701 - DNA, 762 bp, Homo sapiens
  misc_feature (1)...(762): n = A,T,C or G
ngttgactncgnatactcacncttngttgtttntgcaggatcccatcgattcgaattcggcacgaggttcagtgctccccgggattactctggctattcaacgggatggntntcagcagaattcaagcgaggctctgggcagagtggaccacggggagccccacgaggtaatattttgtggtggtgatcctagctcctaagtggagcttctgttctggccttggaagagctgttaatagtctgcatgttaggaatacatttatcctttccagacttgttgctagggattaaatgaaatgctctgtttctaaaacttaatcttggacccaaattttaatttttgaatgatttaattttccctgttactatataaactgtcttgaaaactagaacatattctcttctcagaaaaagttctagttttcaagacagtttataataaactcttaagagaacattntnnaaaaaaaaaaanannnanannnaannannnnaannnaanncctcgaccctntaaaactatagngagtccgttttccgtagatccagacntgntaagatacattgatgagtttggacaaacccccaactagaatgcngnggaaaaaaatgctttttttgggaaatttgggaagctattgctttatttggaccctttttaagctggcaataaacaagttaacaacaccaattgccnttcattttatgttttcaggttcngggggangtntgggaanggttttttaattcccggnccggggc

SEQ ID NO: 1702 - DNA, 729 bp, Homo sapiens
  misc_feature (1)...(729): n = A,T,C or G
nttnatncgttctccgcttgctgcntggcggaccctcgattcgaatcgcccagataagaaatgtcttgcctaagattaaatntntatggatatttttcctaagaaangttttagaaaagactgatgagtgtatttctatgtaattggaatatatttaagttcatgccatgtgtcttgtggtttccttattaccaaaacggtgactgaagaaacgcttgctttagaaatacattgaattggccaggtgtgctggctcacacctgaaatcacaacacattgggaggccaaggcagaaggatcacttgagcccaggagttcgagcctgggcaacatagtgagaccctgtctctacaaaaaattaaaaaattagttggccatggtagtgggcgcctgtagtcccagctgcttggctaaggtgagaggtttgcttgagcctgggaggttgaggctgcggtgagctatgatagcaccattgtattccacctgagtaacagagaaagaccctgtctcagaaaaaaaaaatacattgaattggttcctgatgggaaagtaaatactctcatgcccagttaggagtgagtcagggnttttaatatgccactttttctttctcangcaactcatgcngcaattncagaaccccgactttccaccgagtagaggacaggatgccacacctgcctgtgtcttgtgcctgggagagtgggatgaaacccncagacaanctgt

SEQ ID NO: 1703 - DNA, 745 bp, Homo sapiens
  misc_feature (1)...(745): n = A,T,C or G
antnnnnantnntaagtggggntntannnttttanancnnnnatnanantnagggggagataaatnnannnccttccngaatgggtncngagctaggaaaaagntccatgctatgtgnagaacgaggtgngngatgcagaagcctggnttaatgggaccaacctagctgggcagnnttttgtggaatgagcagttgnagantgaatatagctttgatnttacttntcnacctgngttgtnnagcacgctacagttgtngagatcaacagtcatgtggtgcacaggtnggatggtaaattnnaganntttgnntatagagggaaagnttcngtggttgagagttacagacntgcnaagggagtnctgnagncaaanacctngtanattgataagccattgcatcattaccaaaaatatggaccgcanggaaagcnataacanaanttggtggaggaactgaannggantacttgaggaaaaggnntggganttgtantanaactgtncacnattcttttnntttaagagcnttaanaagaggatggtntaaancacaatgttnttttaagggaganttgnnanantaaagnnnaaacnggaaagaagtggtanagantcattttgnccnaagaaccggaanacaaaanataaangntngatttggtcttacnnaccnaanntgagtgaganaaantcntggnanaaagaaagaatgatngnngaaaagcaaaaaanacaatggacn

SEQ ID NO: 1704 - DNA, 670 bp, Homo sapiens
  misc_feature (1)...(670): n = A,T,C or G
cgactggtcagggttnnnctcaggaagctgagttccagcttgtttccttggcagcactgccaaagagttagaccaagctgcagcttttgaggtgaaaggggatggaagaaagtactgttacttttccacttagaatttttggactttgttcttaatgaataggttcattttcaatttcaaagcaaagtgttaacatttttgaaatttgtctcaattctaaaggccaaacttaaatatgtctcctcctactggggcatggagcaagttattcatcaaatacagattctcgcatggaaaagaaagctaggatagtgtgtcgctgctgctctgtggcaaagaacagctcctttctaagcaacagcctcactctactagaataggtctgagcgcgcccattcatggctgattgcaacttccactgggtgggatttcagatctagaatctgttttcagatgccttaaagagaagacatagaaacacattcttaacagtttcaggggagatagttgggatagtttgtagttttgcttaggttatatgtgtctgttttctgcttttggtgttaacggactaacccttanttttggtggttagagaagtgatggggaagaacataaagaaagctcagatgacattgnctttgctttaaatgtgtagtttttctctcnn

SEQ ID NO: 1705 - DNA, 1228 bp, Homo sapiens
  misc_feature (1)...(1228): n = A,T,C or G
gntngacanttnaataaganggggtnatnanngcatttgnaannccnatnncnnanantagnggggtatcnntantgntgnnnanacgnncgngaanttgntgggagntattctntattanttttccncnttttantnatcntnncctngntggcnntnntantngangantaagtnnantcatccnnctaccncncatggcgttttctctnttcatanttatctnngtntnactttnangntantaantacataatncnnttactnttncaanncntgttttnaannattnctgnantcntgttnagntcncnngtcntaaatgtnnncaatatgctantagattnntcgtataanagnnntnntttttgatntnattatngangnnnntanattanntnntannnntnnangtacnanaatntttagtnattncnacnnttctnataannnnntnattantnaanttaaagntactcnnatcnacnngagntcntnacnntnaacaagtnnctcntgnatnacctnattcttnttctncnattcttnnanatnngtaatcaanacnctnntctntctgnntatannncgaatnaatanatactnatgnncngctntacnntcngtattctcatananggagtatntntactatntntncanngtganntgcacatncntcatgcnctnatangtcanatnnanatatnnntacnacttgnacnattntcnttnacgannntctctctnacacatagtatcantatnganatcncntgntanannataaaantcgntnnattnaggtcnnagaangcaatgttacatgntcacnaatncaatctttctcnatatgtnaatctngttnntnanantcttgntcaatantaactnnatatnaatattctgcgtnttatcgnatnactnancngncatcgattagnggnnactcngnnnangacacganacnatgaatgangtntntntntagtgtantactatattacgtantttntataaagtntaatgtcagacantatngactaaangctgangctctttggattccatanganncacnatanctgagtatattagcnctcatcgcganttctgaaaatgaagntgtatnacgaaatncgattgnaanttctctgatnntggattaaattcatatntaatggacgtntnttanaatancatcantntntaccatgntacagatgcg

SEQ ID NO: 1706 - DNA, 780 bp, Homo sapiens
  misc_feature (1)...(780): n = A,T,C or G
gtttgaatatcanatacaagctacttgttctttttgcaggatcccatcgattcgcttttagccaaggtcacctccgaaggtcctgggaccatggtttttggaaagaaaataatatccagttcatggaaatcctggtncctggttctttggccctggaaggggggtaaagtggacatcagcagcatggttcattccttttcttggtcttctacctgttctccacaaaagtataaaaagccagaattgctttttgggttttgagatggcattgtcttccatttgcaaaaaacagtttataagacaaataataaagaaattgaaatgtttctgatggtttcaaaaatgtaaacataagccagagtagttatgtctcaacatcatctcttgccagccggcagctccttttcttccttgatcttctaaatgtacaggggaagacagctggcagcctgtcatgtttcaaaccttcattaaagttctggattttggcctcttcgttttcccctagatgtcattaaagctgtcagcaccattgctgtgcatgagaaagaggagagtctctggcctagggtggccgcttctccacattggcacccggagtcctncatggggcgangctccgcagtctgcaggtccgttgatctggagtcccggaagaccacgtacacctcaanatgtcagtgacagtgaggactgantaaccctgcagggnctaanatgccaaacccttttgccttctgctgtgcttcgggccggcttggggctttggtggacaccccg

SEQ ID NO: 1707 - DNA, 780 bp, Homo sapiens
  misc_feature (1)...(780): n = A,T,C or G
gtttaatacanatacaagctacttgttctttttgcaggatcccatcgattcgaggccagtgtgggacagggttgtgtaggtgtgccttttcaaacacatttattattcagaagtgggtgcagataacgcttaagattacaccgaagaatttagggagggtgggggatgaaggtctgttagtaaccagaaacacattagttgggcatcagtaaggggcaacataaaggaatggttcccctcaaaaacgaacaaaccaaattttatacaaaaaaatgaaatgcagcagggcgcgatggctcacgcctataatcccagcactttgggaggacaagacagcggatcatttgaggtcaggagttcgagaccagtctggccaacatggtgaaacctcatctctactaaaaatacaaaaaattaagccaggcatggtggtgggcacctgtaatcccagctacttgggaggctgaggcaggaaaatcgcttgaatctgggaggcggaggttgtantgagcccgagatggtgccactgcgctcaagcctgggcaacataatgagactcttgtctcaaaaaaaaaaaaaaagattccactaacccntgtaagctaaaaggaaggggctcttaaaaagacacagatnttagtgacttaattttaaatacttgggtttacctttaaccaaaaagttcantttccccaaacctntttctgcttcangnaatgaaaaacattggcaaaccccaaaacantggnaatagaaaccctggcnttaaagtcttccccn

SEQ ID NO: 1708 - DNA, 922 bp, Homo sapiens
  misc_feature (1)...(922): n = A,T,C or G
angnntttttnnaaaaatttatccaanaaaatnaccaaangccttnacttttgggttttctttttttttggncaaagggaaatnccccccaatccggnaatttccggaaaaatttcccggggcnaccggnaaggggtncaaccttttcccggcgggttcaaaaccccaaagcctttccttgggttggncccttgggccccaagttcccnggggggggccccccctttcccccgggttttcccaagccccattggccttttttccgggcccctttnggcccccngggncttggnccaagcggcttggcttctttccggnccggcaagcntttcaagcaaccctcgggccccaagcggttnccatttggcttttgacgtagctnaatctcctttgcagcatccgtgtgaagttgtgcgtgaataaaagaaatcgtatacttcctaattccatagtatggacaaaccgaggctagagaactgggccagggttacagtcatttggccagaggattagaattcagcgcttctgacctgaagacggcttcctcttaacctttttggaggatctctcctgctgtgggcggactgagcctgccgccaggtgtcttaacagtgcttgacttggcccgcgaccacttaagcctaggagcctaggctattttagccatcttctagaatggtggttcttaaactctgcagtgtgtcagaatcaccagaaagctaataaaaaacagacgtctgggttcattgaagaagcttaagactgcgggggggggtccgcatttttaccaagtgaatctaattaaacctaattttgagaaccccnnnnnaaaaannnnnnnnnnnnnnnnnnnnnnnnnnnnnnnnnnnnnnnnnnnnnnnnnnnnnnnnnnnnnnnnnnnnnncntttnaaaantttnnnn

SEQ ID NO: 1709 - DNA, 900 bp, Homo sapiens
  misc_feature (1)...(900): n = A,T,C or G
ttgaaagactttacaaccncttgctctttttgcangatcccatcgattcggatagcaaaacctgatttttcaaccatgacctgcatgagagaacatcctaagaagtcttagatcatactttcgagttttnaatnttaatttatataantgcntctttatgtcttaatattcttgtgaactggngtntatngtnaatgcntataagcttgtgtnattgntgtnaaatanttttgngattntatttcttgccccatatgtaaatatttagagtctcatttcttgcnaacttatttgaagctgagncgtgggtttgggntntgtttgctnctntggctgcaggntgggntggngggtggcatngggangganggaanggatctatagtccntggacatggtnnatttntntgnnnanaaaaggctacttgtccnnctgcaannnattctcntaacattcacanntntttccnnggtnagancataanntcnttnccnnngantgcctataatnanctcnaccacnttttggcctnnatccnnngngcncanccaangatgtgncnnntggctctaacnactnaantntggactcacttntnanancccttataattccccctgatttnttggncctnntaccatnnntntnnannganntatcttttanaccctntcacngctttcggcgacttcagagcatncttctcctnacntcnncnacccnacttntactttcatgnccacttnctngnaantgaaatntaacttctccnaacgtnctcngnccctcntgnantttgaacnnggcnatcattggctccaantncntccttttactctnttntcctccatantatacnctnggnnaanttcggctggattantccanactntccctccg

SEQ ID NO: 1710 - DNA, 673 bp, Homo sapiens
  misc_feature (1)...(673): n = A,T,C or G
tcngcacgaccaagctgattcnncattctgaaagctgagctggaaagaaccaaagaggaaaagcaagagttaaaagagaaactgaaggaaacagagacacacctggaaatgctgcagaaggctcagggctttggcaaagcttacgcggctacgtatccacgtcagctatctccttacttctgtcctccctcacttggagcttcgtgagatcgggtatgactcagaacaagtggatgggatcctgtacacggtgctggaggcaaatcacatactggattgagcaccagactgtatacccttctcttctcttatcttctgtctgttctcttttctctccctccctcacgtctctctctctctctctctctctctctctcaccctcacctttatgccttatatagagaatctctgtgtaaatcctggctcataatcagtctcctttttatcagttttggtgtggagaaagaggccagtttaaataggctttcaagagtctagggtcagaaaagcaatagtcactaagctaggtgacctgaaagctttaattttcatgacctggatatgtggtctattgtatatctttttctgaaatggtttgtattcatttaggttagacaatcagcagatattgggtccngtataccaggtattattttggggtaagctnacaan

SEQ ID NO: 1711 - DNA, 667 bp, Homo sapiens
  misc_feature (1)...(667): n = A,T,C or G
ccgagaggacagannnnnncccccntggagggaattttggaaagtaaagtgtatgggttagggactactggacatactgggagtacagtttggttaatgagcctgaagtcctggactaagtggtaagttccatctggctttttaacaggtagaattggtgtgtttaaaagggagtttgttgggcggaggaggtgactggcgaggaggcgagaaatgataagctataggcctacaagagctgcttaggggattggatactgcttctgtgataggaactgggtggggattttaagggtaatgcagaagggggtgtggtgttttgcaactgagggtgtggaagtatctcaaaacagcggggttaaccatggatgggggataaggaaaggttgcatgttttanggtgggaggttgcaggagtagaagaaagttagaagccctggaggggtctgggtggatgcgttgggtctaggggaacgtgggagtggagagtggtgtggagttttgaaagcatggctctgcctaagagtggagttgggcatgaggccaggactaanaatgagtgaaaggaagccgggcgcggtgctcaagcctgtaatccccaccctttgggaagcccgagttgggtggatcatgangtcaagagatcgagaccatcctggataccccg

SEQ ID NO: 1712 - DNA, 786 bp, Homo sapiens
  misc_feature (1)...(786): n = A,T,C or G
ttgnannnnnnnnccnttacaactcttgttctttttgcaggatcccttcgattcgaattcggcacgaggggaaaataacccagttttgatcttttttagtctgggtgcttactggatgtcaaggtagaaagtgtccaacaaggtgctttaactataggttggagttctcaaaaangttaaagagggtagagttatagtgacatcttcagcntatatagtagttgaggccagtggaaaatttcccattgagagctctgagaggaaagtttttagaagccaagggaaaaaggagtattgagaaagcgttagatatcacagaaaaattagattggtgatttctaagacaaggatataaccgttaggatgtcattgacctttgtgggagtaataatggggacagaagtcaggttttgctataggttgagggtgtccaatcttttggcttccctggtctactttggaagaattgtcttgggccacctataaaatacactaacactaaaggtagccggatgcgctaaaaaaaacgaatcacaaaaaaaatctcataatgttataaagaaagtgtacaaatttgggttgggctgcattcaaagccgtnctgccacatgcaacccatgggccgcgggttggatgagcttgctgtagattaaagagaaaataagaagtgctgaagcnagaaaagtcatagagtagatgctagccnttanggccgaagtagtagttgaagttatttgttggctcatgtcatagtggngaagaagagaaagaagaactttagggatg

SEQ ID NO: 1713 - DNA, 769 bp, Homo sapiens
  misc_feature (1)...(769): n = A,T,C or G
agttacttagataaagctacttgttctttttgcaggatcccatcgattcgctggtgtccatcagcacctccgtgatcctcatgcagcaacctggctgcctgccagctactgtggacctggctgcacaaggccgccgcccatctgggctgttggcaanaaggtggacccagcgctgtgctccaaacgtggctgcagcacccgtgggactgaagaatgcatgtgggccgcagggcgtgctggtgaagcacaagcaagaacgtctacaaagcccgtaggccactacaacgtggctatcccctctgacgtctcccacttccgcttccatttctttttcagcaaacccctgcggatcctcaacatcctcctgctgctggagggcgctgtcattgtctatcagctgtactccctaatgtcctctgaaaagtggcaccagaccatctcgctggccctcatcctcttcagcaactactatgccttcttcaagctgctccgggaccgcttggtattgggcaaggcctactcatactctgctagcccccagagagacctggaccaccgtttctcctgagccctggggtcacctcagggacaagcgtccaagcttcagccaagggcttcctggcaangggcttgttgggtagaaagtggtggtggggggggacaaaaagacaaaaaaatccaccaaaactttgnattttttggtacgtactggttcttttgataaatggatggngataaaggaaaaaagtctaatttttatactcccaaa

SEQ ID NO: 1714 - DNA, 748 bp, Homo sapiens
  misc_feature (1)...(748): n = A,T,C or G
ttnnannnnnnntcatttacaacccttgttctttttgcaggaccctcgattcgaattcggcacgagagganccaatactgnctttnnntantataccaaaanactanntntatnaatgttgntaaggtggactggnacaacttttgcctgttttggctttttctctgctntttngtggatntgangggcagaggcgcnctttttgntcgtgttntncntggnnnanatnttttannttgtttggtgnntnanaaagtnattggnntcgcncggnatngaganggaggactgntctgattatntngcnatggganattgagtttantaggaaaattgagaggataaaaattatgatgnnanacctcaaanncccgtgaaggntanaacttctnatncatctagagcaggagactggcatgttgaaagactnataacagntggtctggtgatacttgatatcactagggctcctctttcgctcatgcncttgagagacactttatcaagacctgnggtgggccatgcatngtnagntctgntgagagtgatctgaaatgagatacgaagacaggtcatgtactggcctccacgccncatngnagtttggattttatgnnagtgnacangannacattggcagctgtagctggtgatggcannattnatttgtgctnacaangataagctggtgcagcgctnatgccgtatgncaccncttgggagaccatnacgnggacacncaattgan

SEQ ID NO: 1715 - DNA, 773 bp, Homo sapiens
  misc_feature (1)...(773): n = A,T,C or G
ntcnttttncaaactattgttctttttgcaggatcccatcgattcgctcgcgcaatgggctgcctgtggacatcaccaagtgccgcctgccnntgtcaacaaggacgactttgccctggtccagcggcctggcccgggtntgtntncnggnggcgccccgcgctctggtgaactcaccaagctcatacggcngcagcncgagatgtggctgnccactcnaaccaattnacccgctgggnnanattactggaacaccaagtttgaaaagttggcggaggactgtaagcggagcatggacattctgaagcaagccttcgtccggggtctccccacgcccaccgcccgctttgagcaaaggaccttcagcgtcatcaagatcttccctgacctcagcagcaacgacatgctcctcttcatcgtgaagggcatcaacttgcccacacccccaggactgtcccctggcgatctggatgtctttgttcggtttgacttcccctatcccaacgtggaagaagctcagaaagacaagaccagtgtgatcaagaacacagactcccctgagttcaaggagcagttcaaactctgcatcaaccgcaccaccgtggcttncgaagggccatncagaccaagggcatcaagttcgaagtggntcacaaggggtgagctagaaagagccatggccgctgggtgggctccangggangggaagctcttntgaaccaaccatnctgtcccactatacacacatgcccacanggggcttgttcaaaaat

SEQ ID NO: 1716 - DNA, 766 bp, Homo sapiens
  misc_feature (1)...(766): n = A,T,C or G
aancccatacanctcttgttcttttgcaggaccctcgattcgaattcggcacgagatacatggaagtctcaaatctgaatttttatccatctcaatatgaccatttctctctgttgtgagctgaacagattaagtntntttttggccgttgggggatantttggtctatcttttnctgtcntnngnncttnatttnnaaaaattattaaaggnnggntgtggntcttccgtcngttggntttntnaagaatattccataaaatgttttatctgccatacaaaattactgggtttatggccggatgtggtggctcatgcctgtaatcccagcagttcaggattacaggttatatacaggttataacaatggataccaggacatcagaatatctgataaagcaaatatttatatgctaatttaaaatatcaaattgctactggacataaaatacatctggaagcttggggtaagaagaaagaaaagaagtgttccgttctgttttcaactaagggtaaacgaagtcccagagtgttttccctgtaggtcaaattaangtaacatgtctttatttgatcatctattgnacaccagatcctggctaagggcttccttttttctcatgtagtcttncaaatgtctttgataattgtcactatattatagatgacaaagtgaagacttacgagaaattacctttgcccaaggntacaccacttanatggctgtccaaggccggggaanaacccctgcaaatctggtcttgna

SEQ ID NO: 1717 - DNA, 1040 bp, Homo sapiens
  misc_feature (1)...(1040): n = A,T,C or G
gnnttgannctattgaacccttgtntttngcaggaccctcgattcgaattcggcacgaggannctctnatgcactgnntngganaacnggntntttnnncctcnnagcacanngnnacnggnaccaaccnagatgcntccagctgntnctttgtgtaaagntnttgtnggggtttggttgtcttttgtttnatnnanncctntncttngcccttccccctgnnctttaattntnttgnnttantnnnntcccctnnggnggngganggnttnaantntnaaancccccccaccatgttgtcgatggnccctaggattcgaataatcggctcgagacacaccatgggggcatagggaattctctgggtgggccaatggtcaangctttaccnaatcccccnagggtcttcatnggcttggcgcaatccccanataaanggcctngnactccaaanataatccataaaataataaatggcccctggggncncnttttactgngtanaatnanatggggntatngtggnnggtagcactggtacntaactaagggaaaccgantaacaccacaaataccccccccnaaaantggccttgtacctatccnaatncancaaaaccagtggtgnaanaaaccatgactnnggcgacgnctcatgggttncacaaatcaataccgccaaggtcgtattangaacttttgccacanaggttgngaacagtccngcttagggaaatgannaaagaacttgacagggccatcagttncattggnaaaaatggcatggggaatnccagtacccangtttctttgaacccnattttnccncncntttttcaggggggaagtaattggcgtggttttttgggcctcaananaaaactttntttaaaanagntaaagggctaccaagggaaaaagggaaaaaaaattggtttaaggggcaacnaaaaaaaaggcctttaaacttccttgggaaaatgnggnacctanaatttcaatcaagnccaaaaaaanggaanttttntttaaaaaaaaaa

SEQ ID NO: 1718 - DNA, 919 bp, Homo sapiens
  misc_feature (1)...(919): n = A,T,C or G
ggtttgantncctttacaagctacttgttctttttgcaggatcccatcgattcgctcaaagaaatccaagacagacaactcttctcttanttnaccattaattcntaagttntggggtcccgtncacttgaanagtctttgaggggttcgccnttcaaggggaanacttcaaagattccaattttcctgaagaacttntagaagaatgattgaagatgatgtcgcccattaagctgccccttacctttactttcctaaaaaaggcccacctgccagnaacccaagggaagcacagtgacaagccttttgaaggcaaangggcagaagccaaaggcattcttgaatgggacaagaaattccacaggggaatttccaaatcttnccaaaaaaaggactggaagactttcttnaaaaaccaaaaatggaaagcagatgacttttgtttgggatantnggccaaaaggcacgcagnaaagatgacaccgaagcccccacnggaatttcttggggggtncaccttaaggacccttttagttaaaaccntcattaaaacanttttggccttnctggcnagccccttaccaccctttaatttggcatttncttaccaaaaggaaaaaacccaaaggnaccnggggggangggaacaaaggaaagggaagnccgnccccctnggtcccctnggnggnttaattccttccccaaaaaaccaggccttcnggncctttcntcnttcttaagggggaaagaatttggaggcnttcgttctttccccaaaaaaaaaaattggccgaaagttctttggtttcaaaaaaccgccttttgnaactttnttagaggccccaaaaaggangggggggctttcntantggcctggaaaaaacaaacgggaaggaaatnttttgaaaaaaaaaaaaaa

SEQ ID NO: 1719 - DNA, 1188 bp, Homo sapiens
  misc_feature (1)...(1188): n = A,T,C or G
ctttttgggcccnntttaagtgnaananccctnaagntgggaaaaaaacccccntttgggcnaaaaaaatccgcgnagagngaacacagagaangggacnaggagannnancncncgngagacagacggnaaagggnggaatganacatanngaaaaganggggtaaanaaanggagaagagcntttttttttttggnacatatntntntnagagangagcgncgnngnanagacagngaagnaagnggggggncannacatntggggggggggggggggggggggncaacaatatgccacannnaatnnnttacgannanagangaatcncaganagccagnaaangngngacgagtnagcgaanncntgagacanatagagagaannaananagngcnanacgaagnaggagggagcnnnnagtaanaatgnnanaagatgntagnngagangggaggacacgngnnangagaantancgngnaaaaanaatacgaaagagagngggaaggagaggnanannggangangagannnaaaaanatangnntaannanaangancnggncgngnagacngggagaantagaanngggangnanngaagngcganacaancgngnnaacagaatgaggagnngaagnanatgnncnaanaangtgngtganagannnagagggaagagaanaggnantntnangacganangnncancggngagatggaangnggcganacnnnncagagagaanggancgganaagnannnaagnaaggacngacgacgaannancaatnagnagaacncaacgtnagcagaaggtagnngnacacggcnnnntanaggaanagnngtacaggtntnttannnngnntagaggaaaangaggancntgcgggacgagcgtagnnagaaagagagagtncagnatnggngannaaggagnaangagntgatgtacggangagngnggggacganggggaananacangnnagaaatanngaaagagagagaagcgnnnataagatnaagnagctacagaagngaatgtcatgngatgcacgggatagngagntgtaaacgacanangaancagacgntagnagntgnatantcagaaaagggnggnngngannancnggacggnggagngnaaatgatgaagngngaggganaangngn

SEQ ID NO: 1720 - DNA, 788 bp, Homo sapiens
  misc_feature (1)...(788): n = A,T,C or G
aannnnnnancttttttgttcntttgcaggatccctctnttcganttcggcacgaggctaaacatcaaaaacagatctggtaggggcggggaaaatgagggggaagaaacaaaaacgtgatggtgcctcatgctgcttaaaatcttcagtacattgatgttttgatggcggactacataagcgttaaaaattgtgtttttcagatctttaaaatataagacagtgcttctagtgaataaaaaaattagtttgaaagatatctggagaaatcgcattcataaaacaattggaagtgaaactattaaaacaatagggctttttaaaattaaaaatatttaaaattcaaaagtaattaatagtgttggaagatgtaggtgagaaaatattcctgaaagtagaactgaaagagacaaagagaaaagatgaaagccacagaagataaatacaggggtcaaaaccagactaacagttttagaaagtgaaaaaagttaaaaaagaaatgggggcagtgggttattagaaataacataaatggctggtatggtttgtctgtgtcctccccaaatttcatctcgaattgtaatccccataatccccatgtgtctagggagagacctggtggggangtgattggatcatgggggtggtttncccttacgatgttctnctgataggtgggtggagttctcacaagatctgatggtttttttaaagggctcttgcccctttaactcctcactcttttcttccttgaaacccttgtgaaaaaangngcntttgcnttnccn

SEQ ID NO: 1721 - DNA, 750 bp, Homo sapiens
  misc_feature (1)...(750): n = A,T,C or G
ggtttnatncnttacaactcttgttctttttgcaggatcccatcgattcgaattcggcacgagggtggctcatgcctgtagtcccagctattcaggaggctgaggcatgagaatcgcttgaacctgggagtagaggttgcagtgagctgaaattgcaccactgaactctagcctgggcaacagagtgagacttggtctcaaaaaaaattaaaaataaaaaataaattgggggctgagtgtggtggctcatgccttcaatctcagcctcccaagtagctgggattataagcatgcgccaccacgcctcgctaattttgtacttttagtagaggtggggtttcaccatgttggtcaggctggtttccaactcctgacctcaggtgatccgcctgcctcagcctccaaagtgccagtattacagacgtgagccgctgtgcctggccgagtaatttttttttaaaaaaaaagcctctagaactatagtgagtcgtattacgtagatccagacatgataagatacattgatgagtttggacaaaccacaactagaatgcagtgaaaaaaatgctttatttgtgaaatttgtgatgctattgctttatttgtaaccattattagcttgcaataaacaagttaacaaccaacaattgcattcattttatgtttcangttcanggggangtgtgggaaggttttttaattcncggccgngcgccaatgcatttgggcccggtncccaactttttgtnn

SEQ ID NO: 1722 - DNA, 735 bp, Homo sapiens
  misc_feature (1)...(735): n = A,T,C or G
gttgactacaaatacaagctacttgttctttttgcaggatcccatcgattcgaattcggcacgagatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttagcaaaccctaccttgcttgttaaaattttttttttttttttaaaaatatctgtaatggtctgactttgcttgctttgaaagtaactctttttttttttttgcagtaactgtttttaagtctctcgtagtgttaagttatagngaatctgctacagcaatttctaatttttaagaattgagtaatggtgtanacactaatnatcataatcactctaattaattggaatctgaataaagngnacaattngtacccttttttatnaaataacaaatanaa

SEQ ID NO: 1723 - DNA, 757 bp, Homo sapiens
  misc_feature (1)...(757): n = A,T,C or G
attnnnnnanctcttgttcttttgcaggaccctcgattcgaattcggcacnagcggagtgntggcttncattttttcttgggcaagatgganaattcncttcctgnncctccatcntggccanaatctaanttntcntntatgccggttttgcttggtgnttgttatttttatntgcnnctgctngcnatgtnttnntgntgncttncngaaatgtntgnacttttggnattcttgttggngagaaatctacttatttatttaaatagcttcgacataccctgccctcactcataattgcggggtggngagcacacccaagtttattagnaaaagttntnctatttanacatatctagaantntntgtgttaaatncgtaaggaccaaaaggaagnantcttntataactgctntttntangnnaatgtgagctaactttgaggctatatancatatgcancanagcttgtgaactgaacacttgtggtcccatnaggngtgcaagcatgttntacttggntcnncactatctnggttcctgcgangntctnnaacgatgnaaatgttcgctgttaatgagaagtctggaactnccatattctcttaagacattttgcggcttccaganatactcttaaatgactgctncaaagctcaaagacttgnagccccntggtggantcctccattagatggacatgcattctccanctaccntgncccatactcagggaacncaaccaacactttcancan

SEQ ID NO: 1724 - DNA, 830 bp, Homo sapiens
  misc_feature (1)...(830): n = A,T,C or G
attnnnnnanctacttgttctttttgcaggatcccatctattcgacttnngcncgangaagccngncaacttctnggatctnggaggtgntgtaaaggnngctcaggnctatcancccttcagntcgctcanagctgnttctcanggtgaagccttccttgttgntntatnnggaggatcgananctgtgccgtgcttgtctttgggntggnctnccnctgccggnagctanaactaatggtgcccctggnggtccggcttgaaggaaccaacgtcncaaccgcccatannatnctcacnnacngcggactccccntnacttcacncnttnacctngacgatncntgcaaaaagctgtggccagngngnccaaaaatgntgtctttgtnctnatccnanggtgaacgntgccgntnttncgtaaaaaggnatggttcatcattgtgnaagaaaatggatatctcattggcgaanaaaaggggannnnggaaggcaagaatcacttgannaatcntaaatctgtggtgantggaataagatatctctaacaggctaantctgattttaggcctttataaaaaatnatanctngggngngctccatacttnanttgtcacttgtnatgcctggcccaaaangccaatgtnttgccatacttttgggggagcgggacnntgtgggnccaaaaaattgcggggcntttgaccccnaantttgnaaatcaaagttccttgctttcaatntaccaanaaantttnggggggggcaatcttaatnccttnccttaaatggaaaggggctaaaaaccccttcnttttccnaaaacctn

SEQ ID NO: 1725 - DNA, 1089 bp, Homo sapiens
  misc_feature (1)...(1089): n = A,T,C or G
agnaaagtgaaaatcttctttttactacangncttgggcatgggccctgggcaggggtncggaacttcttagganggnatccccgggggttnacccggagncttcggaaatttcgcccttatagtgggagtttnttttaattaacaaatttccaacttgggccccgtccggttttttaacaaacggttccgttggaacttgggggaaaaaaaacccttgggccggtttaacccaaactttaaatcggnctttggcaagcaacaatncccctttttcggnccaagcttgggcggtaaataaccgaaagaaaggccccggcaanccggaatcggccctttcccaaacaagtttggcgccaagccttggaaatgggcggaaatgggaacgccgccccttgtaagccgggcgcaatttaaagccgccgggcgggggtggtgggtggggttaacgccgccaagcggtggaanccggcttaacaactttggcccaagcggnccttaagccggnccccgnttnccttttcggcttttcntttccctttccnttttcttcggncaacggttcggnccgggcttttnccccggtcaaagcttcttaaaatcgggggggcttnccttttaagggggttccgaatttaagtggcttttaacnggnaaccttcggacccccaaaaaaaaactttggattaaggggtgggaatggggttcaacggtaagtnggggcccattcggcccttggaataagaacngggtttttttcggcccctttttggacggntngggaagttcccaacggtttcnttttnaaataaagtggggaacttcntttggttnccaaaacttgggnaacaaacaactttnaaacccntatcttcgggggctnaattcctttttnggaatttaaataaaaggggaattttttggnccggaattttcnggncctaattngggttnaaaaaaaatggaagctggaatttnaacaaaaaaaatttnaaacggcgnaatttttnaacaaaaaataattaacgcnttaacnaaatttccttggangcnggggantttcttnccttaacgccaatntgggngccgg

SEQ ID NO: 1726 - DNA, 754 bp, Homo sapiens
  misc_feature (1)...(754): n = A,T,C or G
agtttantncnatacaagctacttgttctttttgcaggatcccatcgattcgaattcggcacgaggaaacatggggaaaagttcgtaaactcctggttgatgcaattcataatcaactaactgacatgggaaaaatgtattttgaaatatatgaaaggaacatctattgtggtccctgaccactgcactttttattaccagggaaaaaaaatcttgtaacaatttcatatccttcaggaataccagatggccagctgcaggcctataggaaggagttacatgatcttttcaatctgcctcacgacagaccctatttcaaaaggtctaatgcttatcactttccagatgagccatacaaagatggttacattagaaatccacatacttaccttaatccacctaacatggagactggtatgatttatgtggtccagggcatatatggctatcatcattatatgcaggatcgcatagatgacaatggctggggctgtgcttatcgatctctgcagactatctgctcttggttcaaacatcanggatacacagagaggtccattccaacacacagagaaattcagcaggctctaatcgatgccggggacaaaccagcaacatttgtcggatcgcggcaatggattggatctattgaggtgcagctggtactaaaccaattgatcngtataaccgtcaaaaatcctgtttgtcacccaaggtcaaaaattgcctnttcaaggccgggaacctggctaan

SEQ ID NO: 1727 - DNA, 800 bp, Homo sapiens
  misc_feature (1)...(800): n = A,T,C or G
gnnnntnnnnnnnnnnncaactacttgttctttttgcaggatcccatccgattcgaattcggcacgaggtacagcaggccttgatttcaacaataaaatcccgacctcccttgctgcgctgcactgcccccgggagctgatgggttggagactggaaatcagaaaacacacaatccagaaacatggtttatctggaacctaggtatataagatgccaagataagtcaaattcacagagacacattgtagaatggtgattgccaggggccacagaggagggcagaaataagttattcttgaatgagtacagagtttcagggttttttgnttttggttttttttttttctttanacagagtcttgctctgtcacccangctggagtgcagtggcgtgatcttggttcactgcaacctctgcttcccaggttcaaaagggtcttctgcctcaacctccgagtagctgggattacatgcatacaccaccacgctcagctaattttttttgtagttttantananatggggtttcgctggtaccccatccngccangctggtttaattattnattttttaatttttttgagctaaaagtctttgccctgtcacccaagcttgggggttcaagtggcatgaatcttaagcttaactggnaanccttcaaccttnctgggggttcaaagtgaatcggtccccaaccttaaancctttcccaaagtaagcttggaaaactaccggggtggggccacccaaccattgnccccaacctnaaattttttggggatttttgggaaggngggg

SEQ ID NO: 1728 - DNA, 753 bp, Homo sapiens
  misc_feature (1)...(753): n = A,T,C or G
agnttnaatgcgatacnagctacttgttctttttgcaggatcccatcgattcgaattcggcacgaggtggcgcagtctgagttcactacagcctccacctcccaggttcaagagattctcctgcctcaacctcccgagtagctgggactacagttgaaaaagatcatctagcaaagcctttttcccagctacatataaggaatttgaaagtcacataaaatggttaagaaaatgtgccaagattacctcagtaattctggtctgtgttctcaggagaccctggaaataaacaatgtgtcttctgtggcttcagcgtcacctagtgcaggctgccattcaacaaacgcattgtcaacagtcaaccaaaagaaacccattggccaccataccctgaggactaaccctgacacagatgcccttccagatgccctcaatagtctaactgattccatcgccccagccttgggggagaagcactgctgcctatgcactccatttacagaaaaacgttgacctcttggcgagaatgcaaagaagggaacgcttgcttatacactgttggtgaactgtcacccctacaactcagcttgcaaccagccctggccaccagtttncccacactgagctgaatatcggacatgcccatcttagacattncagcccattctgaaattccacatcgattcacctgacaaagtctgaagttncanggcaatttatcttggaaaagcttacctgggaatacgtgtcatt

SEQ ID NO: 1729 - DNA, 747 bp, Homo sapiens
  misc_feature (1)...(747): n = A,T,C or G
agtttnacttcnnatacagctacttgttctttttgcaggatcccatcgattcgaattcggcacgagagatcactcaaaatttgcatgtgaagaatataagcagagcatcggtagcactagttcagcttctgttaatcattttgatgatttatatcaacctattgggagttcaggtattgcttcatctcttcagagtcttccaccaggaataaaggtggacagtctaactctcttgaaatgcggagagaacacatctccagttctggatgcagtgctaaagagtaaaaaaagttcagagtttttaaagcatgcagggaaagaaacaatagtagaagtaggtagtgaccttcctgattcaggaaagggatttgcttccagggagaacaggcgtaataatgggttatctgggaaatgtttgcaagaggctcaagaagaagggaattccatattgcctgaaagaagaggaagaccagaaatctctttagatgaaagaggagaaggaggacatgtgcatacttctgatgactcagaagttgnattttcttcttgtgatttgaatttaaccatggaagacagtgatggtgtaacttatgcattaaagtgtgacagtagtggtcatgccccagaaattgtgtctacagttcatgaagattattctggctcttctgaaagttcaaatgatgaaagtgattcagaagatacagatcngatgatacagtatttccaagaaancgctccatctgtgtt

SEQ ID NO: 1730 - DNA, 749 bp, Homo sapiens
  misc_feature (1)...(749): n = A,T,C or G
gnttnactananatacaactcttgttctttttgcaggatcccatcgattcgccaaagcacacaaatggcctaccatcttttattcttccttctagcttctggagagagaaatgattgttccagtttagaatgccaggagtttactgggtgtttgtattttttatctgtgccttaaaaaaattagattataatgaacaagacatctttatgttttacagggaaggaaaaagcagtgaaagtatgcattttcgaaagaaaagtgtgttgggaaaagagagagagggtggaaacccaaaggagaaataaaaattttaagtccttgttgcagtagctggaggaagtgagcttggaaatctctccagcgcaatggttgctggctgggaagaaagatctgacttagacacagaataagctgcttgtgctgggtgtgtttgtgagctgggtgaggttttctgtgtcgctgggcacgtgagggaagttacgtggctggggggtggggtggggggcattagaagggagtatgggtgtctgtgggcgctcgcgtgtgcgtgtatgtgtgtgtgtgtgtgtgaaanaananagagaaggtaaaattaactttgtcctatatgttggtttctctgctanagtcttaaaggaacttgcagctgcatttttattggttcaattccacattctctctaggattgttggtgttatttgggtgatgataaagccaggattaanaaccanactgggncaattnaaan

SEQ ID NO: 1731 - DNA, 1116 bp, Homo sapiens
  misc_feature (1)...(1116): n = A,T,C or G
ntnannananagagggggntnnnnttcttnncnnnnnngtnnagagggggggaatannnntgnnnatntngcttcnttngtgtgntgtaatnttgaantgtgtggncgggggggggggggggtgtgactaattnatcttatttaaatcnnnntattnttaataatatactattncttnttcnganangagatttttntncaantngntnctttatnnatagnaggtntnntcnnnnanattnntgtnnntaggnntgattattanntgtnaatctgtanttngtncnngnantttannattnactgnntagtncattggttntnnnntcanntgttagtacgngnattcgcgtacgnnaaatnttantatagtnatatagtganannngatntctntatgtacagtanatgtnagntctanncgtgngacntatgagngtgantactnnaganncgatanntaaggtgtntactgnngataactnctcangaantcagtgtgacgangntnagcggataatangangnaatggatangtatatatatggtacngtttncgtacgatgtgtgncagttngaattagnagttagtgtcgatagatagnttngtntganatntgagatagtgagctattatnntatagctcnttnnanatgngnagngantttnnatatgttatattattcnttnacngtcatantgtgtagacattagngactagtnctnntangtgngttgntnnngtagaacgatnttgntngttgagntttnnnataccntaganttancattgnntgntntgtntnntannatntatgatngtatgatgcagtattagtaaatgntnnangggaannnagaatnntannnncgttnanncttantnatctttgaanatcaagnnangtntngnagttnntnnngnttcntnnaaaantnannnaatnnnattnnngatnnttnnttatnttgtngnanaantngtgattngatatgtatncgtaatgaaattaactgttnnnnntttagnananaattantggtaatcnnnntgntnacncacnatctngtgatncggntggacatnatntgnntgnngngacntctcnagtng

SEQ ID NO: 1732 - DNA, 748 bp, Homo sapiens
  misc_feature (1)...(748): n = A,T,C or G
ttgatncgttacnnctantgntgcntgtgcaggatcccatcgattcgaattcggcacgagcgccatgttgcccaggctggtctctcctgagctcaggcaatcggccaccttggcctctgaaagtgctagaattacgggcatgagccaccgcatccagccagaaagatacatatctaattctagaaatagcatgcagtatcagtcatagtaacagccatgtgctgacctaaataaaatttcttgatattgtgtatttaacctgaagtattgagctagtttttttgttttgttttttggtgctgaacattttggtctaattctttggcttcttagaacattttaaaaaatctatgttttgctatcagccaaagtaaatgtgttcacactaacatataagttactaaccttcattatacagcaaagctaaaaagtggtgggatatttggggtcttaatgaaaattgtatcatttaattccataaatattaaaatatttgggtaccttttaagctttttttctttccttctataatgggnggtacaagttctatattcattcagtttaatctcatttgaaattgtttaaatcagagtcatgtaaatatttgtgggtttttttttggtttatagactcgagcttttcttttacacagttttttttagggaaaaactaaagctattanggaaattctaaatcttgttgatgaaaaaattgggcttttctttggatataattaataaaaagggat

SEQ ID NO: 1733 - DNA, 753 bp, Homo sapiens
  misc_feature (1)...(753): n = A,T,C or G
agaannatctctttgcaactccttgttctttttgcaggatcccatcgattcgggctgccccagcgttagcagcctgtaccaggtctnttncccgctctgcccacggctgtgtacgacatcagaccaggcactctcagggccgctctccagctcaccacagtgtctccacgtgccttaccccttctccttcaggccaagtttcgcggggtgttttattaagacgtccactagaaatagcttgtcctgtcaactatgaaatatggtgactagattttaattcataaccgtaaagttttttaaagttttgggttagtaatttgttttactagaatgacaaagaagatgtaaaccattttattctgtaggctttttactcaattatgtacaaaccacaaatcaggtactgtattttagtgaagcattgctttaattgcaacagaatagcttttgtggctatcaaatgaaatctgtaaataggaggtggagggcaagccatcctgactgagcagttttaaccgcaggttctaaagtgtcccgcggagtacagataatattctggaaggtaactgtttactacgacagagacgtggcattttggaaacgaaacttaagatgtttcatggagcttattttgagaactttcccatttcaggtttctgcattcangctttacatggtcaagttaactcagagaatcccccactggttatcatcaactnctctgaaatgtgaaccctttnnaacttgngctca

SEQ ID NO: 1734 - DNA, 690 bp, Homo sapiens
  misc_feature (1)...(690): n = A,T,C or G
tnnntcnaattcngccgagattcgaccctnnnnnccnngcctataagaccctcctggcccccctgagcagaggactgtaccttgtaagctaaagctccatggaatagagattcctgaaaggacagattatgaaatggacaggcaattcctcatagaaataatggaaatcaatgaaaaactcgcagaagctgaaagtgaagctgccatgaaagagattgaatccattgtcaaagaaagaatttactgacaatgtgagcagtgcttttgaacaagatgactttgaagaagccaaggaaattttgacaaagatgagatacttttcaaatatagaagaaaagatcaagttaaagaagattcccctttaattgtggatagtttaaagtttaaaaaataaagttcttgctgggcacagtggctcacacctgtaatcccagcactttgggaggctgaggtgggtggatgacaaggtcaggagttcaagaccagcttggccaacatagtgaaaccccgtctctgctgaaaatacaaaaattagccgggcatggtggcgcgtgcctgtaatcccagctacttggtangcccgangcaggagaatcgcttaaacccgtgangtggaggttgcagtgagcaaaagatcacgcaactgcactncactttgggcaacagaatgagacttaatcttgaaaaata

SEQ ID NO: 1735 - DNA, 760 bp, Homo sapiens
  misc_feature (1)...(760): n = A,T,C or G
gttganttcnatcaagctacttgttctttttgcaggatcccatcgattcgaattcggcacgagcttgatatcaatggcctgccatatggtctgtgtgccggctgcgtgaatctcagtaagagcgccagcccaggcattaacgtccctcccggcacgaatagaccaggcttgggccagaatgagaatctgagtgccattgaggggaaaggcaaggtggggggactgaagacacgctgctctagctgcaacgttaagtttgagtctgaaagtgaactccagaaccacatccaaaccatccaccgagagctcgtgccagacagcaacagcacacagttgaaaacgccccaagtatcaccaatgcccagaatcagtccctcccagtcggatgagaagaagacctatcaatgcatcaaatgtcagatggttttctacaatgaatgggatattcaggttcatgttgcaaatcacatgattgatgaaggactgaaccatgaatgcaaactctgcagccagacctttgactctcctgccaaactccagtgccacctgatagagcacagcttcgaagggatgggaggcacctttaagtgtccagtctgcttttacagtatttgttcaagcaaaccaagttgcagccacatattttctctgcccatggacaagaaagacaagatctatgactgtncacaatgtcccacagaagtttttntttcaaacnaacttgcngaattcatacaatgaccccaccacanncattttt

SEQ ID NO: 1736 - DNA, 750 bp, Homo sapiens
  misc_feature (1)...(750): n = A,T,C or G
gnntttgantncanatacaagctacttgttctttttgcaggatcccatcgattcgaattcggcacgaggcactcggtaaactctgggactggagccaagagactgtgagaaatgacctttctcatcaagtttgtcccaagccaggcttaaattgatagatcgtctaggttttctgatgctggtaaagagactctgtgcctcagggacaggtctgcaaagatcattaagaaacagattaaaattagggagcaagacaagacaagagaaagtttctttacgttctcccagacctctctgggcctataggcagatcaaatttggcctctagatcagcttggacaaaatgatgtccacggtgtctgagtaggtcttttcatttttatccctcttatagccatctttagctgcaggtgccttttagagttatggtttttggaacttagggacattttaaaataaagaatgattattgctcatgatgactgngctaatgagtggaaagaacttgcttttttttcttcttttaactaacttagcctcagttaactagtaaatgtaattttttttctttcttagaagaaaaatatttaaaaaaaaatagatctggcctctggcttgctacccaccttggaggagtctgggaagtctagacaatgtcctangagccagacccactctgcagtcatttgtgaatgaattattgtatcatatgcngncttttgaattcatactttgagccaaatcccactt

SEQ ID NO: 1737 - DNA, 1191 bp, Homo sapiens
  misc_feature (1)...(1191): n = A,T,C or G
cacccnnnacncaananaannannnancannacacancnnanaaanancnnnaacnnaananaaaccaanacnaannnnacccnccnnncnnaccacncctaccncacnnnnncccnnttttttttgaaaaaccccttnnnnnngancgggnnccacncnaacacccctctnncnnnaaaanncccacnanntanaaaaacacccatacnacccactatntcacaanaccataacacactacnacatnaanncntccatncatattcacaatctacacannctacnnacacanntatactnatacacacactnatcactctaccctacacaatataaaacaatntctaaacnannanaaacatacacnnnnnaactnnacncctaatccncctcnaacacccnaancnaaanactacnnccccatccataananaaaantacnccnncaaacancacccnanaaaaanntnaantcatacncctcacaaccccaccctnaaaacaccacccanctnnnnaanaccacacaccntcccaaacnataacncacnaanaanaanannanaaaaaacacaaacaccanaaanacnataaaccnacnacnacatacncaaaaccccncaatacanannaannnnnaccnccancacntanccantacncaccnacctcancnaccnnaccctccnaactccncaccccnanctcaccactccantcacaacaaccctcccccacncactcanacattatcacacaccncananaantcacaacnatnaaaacacanccactaaanaanaatnacnnacncanacaacatntcanccacaacccctactnaccnccaccaacactntatcaccacatcnannntncctncctnccatccttcnaaaatactcaanataccncatcactacnccatattacacnacnactcacncaannannttacactcactatcacancacaacntctncactcnacactctanaccctccnancananacaaactatcacaaccananacnatacacacnatncatatatctcacacancaccanatnannnctanaacccanatntantncacanancantcacnaaactcactccacttcaacacntactctatcaacaacnctacatcacnatatncatcaacacatacnananntaacann

SEQ ID NO: 1738 - DNA, 745 bp, Homo sapiens
  misc_feature (1)...(745): n = A,T,C or G
ntttgattcgntacaagctacttgttctttttgcaggatcccatcgattcggttttataagtggagtcttcagggaatgattatttgggaattaggctttgaaagagcctcagctgtgttccaccccctccaagaattcaggctgttatttttcaaggctgccacagaggtggggagtggaaaatgagactagtaagttaaaatactacaaagcttgctgttcttacagaaattcagccatttttcttgaataaacacttccatggattgctgcaagccttgattaattgccagaatctgaaatggttgcttttgacagtttttttcccataggtttttgttgcttttatggaagagcaaagttttggaggttcttcaccatggtcagtgacatcatttcttggttttgctcttgccccctctttctttctgaagcatcataaggattagaatgatccttgtgttgatgagttctctttgtgacatgttgaatgatgctgtctgtggcacatncaggaaatgtctaattcacagctgagtttcagaatctggatcttgatgtagtcatctatttatagatgatagttaaaacaaaagtggattaaatagcctaaataaagcatttataatgaaataaccaaagagcttctatatttgaagttggataatgcttccnannaaaannnnnnnnnnannnnnnnnnnnnnnnnnnnnntnnnnnnnnnnnnnnnncntttcnncttnt

SEQ ID NO: 1739 - DNA, 735 bp, Homo sapiens
  misc_feature (1)...(735): n = A,T,C or G
gttgacttcgntcaagctacttgttctttttgcaggatcccatcgattcggtttagtgttcctccactgctagaaattttggttgttcctgatttttattttcccttttataaatgtctctttggtgaacgttattagacttacagtataatccagttgatacataagcgaatgaagacagtaaccctcaaacagatgtgtgtgtggcatgtacattaactgctatcctttcagcactttgttttgttgaaatggccatttccattatgttcaggaaaactcattttgggaagaataagcaataaatttgtaattaatgaaatctggttcagtttttcagtttgtccaggttttaagagaagttaggcactggcctagctttaactgatgtctgttgccagtgagttgagatcatcaggattgctctgaatacatgccagataaggacgctgagtaccagcacataggcacgggtgaatgctgcttcaaatggtcaaaatgatgttcacccataaagcaacaagaacatgttaatgacatacgttgaatggcacctcttgaagtccaaagtcaggactttattgattaccatatgaagtgtttcctgggatgcccagcatgtttccagaaganctgctggggtgcatcgtgggtttatccagcttggncatgaanggcagatctcaactatgnatgtttcatcttttaaacaaaccttggcatagaaaccacaga

SEQ ID NO: 1740 - DNA, 753 bp, Homo sapiens
  misc_feature (1)...(753): n = A,T,C or G
nngttgatncnttacaagctacttgttctttttgcaggatcccatcgattcggtaaactgtatatctgtaatatgaatcccagcttttgagtctgacaaaatcagagttagggatcttgtaaagggaaaaaaaaaacaaaacaaaatgggagatgagtacttgctgagaaagaatgaggggaagggagttggcatttgttgaaagtatagtctttttctcttttttttttaattgcaacttttactttagatttaggaggtcgtgcgcaggtttgttacatgggtatattgtgtgatgctgagcttgggatgcgaatgatcctgtcacccaggtagtgagtatagcacccagtgaaactgtagtctcatgccaggcactgtgctagcccactctggctcatttaatcctctcctaagaagagaggagacacagcgtccccatttgacagatgcagaaagaggttccacaggtgtgccttgattctgcctaaaaccgttnccggaacttttcctggtgtgggcgcttctaacctaatcctcaatcgattccagaactattactctgtttccacagtgatactgtgtctaggttttanggaggacagttcattgatgttacttaaaaatgctttccaggtggnaagttccttaagttttgaggcttcaaatttccttacagccattaaaatcccattcatgantttgaaatactgntctgtggcttggaaatcccaatcagaatggttggctgaa

SEQ ID NO: 1741 - DNA, 822 bp, Homo sapiens
  misc_feature (1)...(822): n = A,T,C or G
agttgaatncntatacaactacttgttctttttgcaggatcccatcgattcgccttggtgcatgggcctggagccctggggggaactgtgggaactctgagccgtctggccctgagggctcagcctcagcctccacatctgcctgttgcggtcctggctgtggggtctcaggataaggacatagccccctggaagctgggaaggccccacatcaggccttgcagtttctaacccaggaggtggccgacagcagtgcgttggggctgcctgtccctgcacacgaagccctggggggtgaatggaggctctccctgtttttgttagcattggaggcctgagcagggctaacgcccaaccgcttgcttaaagcgcataaagatgctgagatggaaaacgtgttgcatggtgtaaaccatgcaaagcccttccagccagtgcaagtgatcgaggcanacagaanggaaaccgccttttgcaaaagagaagctcggctctctctggggtacacagatcaacccaaactgngcaaagctcacattcatcccaacttcacaagcttgcctgcattcctgtttcacaagcaccctccttgtnccgttgaaccctttcttccccccacttgaagtggggggggcttttcgggccttcaaggtgggggggtgttttgcaagacacagcctatttgntccttgtnccccttggaaacttcattaaacnatagaacccatggggcnataagancttgtttccttgaannccccaaggttcattngcaacnaattaaccctttttcaacattcanancccaacagttaattgcct

SEQ ID NO: 1742 - DNA, 784 bp, Homo sapiens
  misc_feature (1)...(784): n = A,T,C or G
nnnntntgaactnnttgtnntcnctgcaggatccctcgattcgagccgagctgggccgtcctggggatcggtacagctccctggggtnttnacaggccctttgtgaaagttgtgtgcttggtcttccaccccaccccaacactgnttcaaatagcaccaaccagatgggagtncncatctgtggtggcaaaatgctgacattttcccaagaggtcacaaggtgggagangcctgctgtancanaagtgtgtgttagagaaacaggggcctgatttagtngccananactgggtgagaaaaatggccanagaaagtgacctgccagctaccagtgtttccgaaaatgaggntgggatggcccatttcagagcangacacagtcatncccatagccctctgaggagggganggatgcttagagcaggcatttcttgtcagntctgacgtggcangtgccattgnaacttgtgcngaggagtcttaggaagtgctgccataattcataaggtcaacancacatctggatgaatgaaccacctgaaatgtgtgtgggctgagccacaggaagggtgaatcctcttgcttgnggngctttatggggtgcaggttgcttgcttttccacattctctcattttgcttgaagcagcctaacaaaagggagttccccaaanagctccatgaaaaccttaanaaaattcattttcctgnaggaccaaagaagaccaanaatttgtnctttggtcacactggttgaagcttctgtctttacaacntgattgttct

SEQ ID NO: 1743 - DNA, 751 bp, Homo sapiens
  misc_feature (1)...(751): n = A,T,C or G
agttacttcgatactcctcntgcatgcctgcgntnancncttcggatccaattcggcacgaggtccatgctaatttctagattgatgttttagccataaaaatgcagtatttaataatattttattttccaaattatgggaaagcttcagaaatagaaatattcaatataattagtactctctaatcttttttctaggttgaaaaatctttgttttgctttaggttagattatgttgaaacacatctgtgtttcagatgtgttcagagctgaggtctcagctgaggctccactgaagcaggattcacttccaaaataacagagttgttgccaatattcagttcgtagcaaactactggaacaagaatctgttttcttgctgagtgaatttcttgccatgtggccctctccaaatgctggacataaaaaagtaggctgagcacaatggctcacacctgtaatcccagcagtttgggaagccaaagtaggaggatcgcttgaggccaggagttcaaaactagcctgggcaatatagggagacccccatctctacaataaataaaaataaaagctttcatttacaatgatggtagaccaaagaaatttgtcctagatcttcactggagaacatctagaaaaagctggcagctgacaaaaattttaaaaacatctgggctgggcccggtggctcacacctttaatncccacccctttgggangcaaggctaggggatcacttgagctcangagtt

SEQ ID NO: 1744 - DNA, 742 bp, Homo sapiens
  misc_feature (1)...(742): n = A,T,C or G
tacaaactacttgttctttttgcaggatcccatcgattcgaattcggcacgagctttnttgnatttttacgctntgctgtccatgacatatttctaacacctttatgattattgnncctgcttgnaaaagggntggnatttntntgngtnctcngntcgnagaaaaggtnnntgtgcccccccttctgggggcagtttgncactttgctttccngtnctgngnncntngcntgagattttttnaaanactcccgcangctttcacttagtttcattgttgagaactgngacaggnccatctctagctgcaaangaggctgagaaagtgaacacagcagtcctccttatccttggggaatacattccaagactggatccctganacagcagatagtactgaaccctatatatactatgtntnngcctatgtatatatacttgatatggtntggctgctaccccacccaaaatctcatctagaattataatccccaaatccctatgtgttaagggtgngaccangnggagataattggatcatgggggcaattnccctgtgctgtcttgagataatgagtgactctcangaganctgttggttttataaatgcctggcgtttnnctgcttgcagcactncatnttgctgcctgtgaaagngcctgcttctcttgccttctgccatgaatgtaagtaactgaggccttccagcangcngaactgtgagtaagnnacctgtttctt

SEQ ID NO: 1745 - DNA, 745 bp, Homo sapiens
  misc_feature (1)...(745): n = A,T,C or G
agtttaatananatacaactacttgttctttttgcaggatcccatcgattcgaattcggcacgaggatgcacgggcactttggaggaccgagcggccactctgagtaagatcatccaggtggcggtggaactgaaggattccatgggggacctctattccttctcagctctcatgaaagccctggaaatgccacagatcacaaggttagaaaagacgtggactgctctgcggcaccagtacacccaaactgccattctctatgagaaacagctgaagcccttcagcaaactcctgcatgaaggcagagagtccacatgtgttcccccaaacaatgtatcagtcccactgctgatgccgcttgtgacgttaatggagcgccaggctgtgacttttgaaggaacccgacatgtgggaaaaaaacgaccagagctgtgaaatcatgctgaaccatttggcaacagcgcgattcatggccgaggctgcagacagctaccggatgaatgctgagaggatcctggcaggttttcaaccagatgaagaaatgaatgaaatctgcaagactgaatttcaaatgcgattgctatggggcagcaaaggtgcacaagtcaatcagacagagagatatgagaaattcaaccagattttaactgncctctccgtaaatggnacctncttctgtaaagcangcaganctttgatactcttcaaaaaacctttanaatatcttttcaagnttcccacttt

SEQ ID NO: 1746 - DNA, 748 bp, Homo sapiens
  misc_feature (1)...(748): n = A,T,C or G
agttgantncanatacaagctacttgttctttttgcaggatcccatcgattcgaattcggcacgagtgtaggcacaagattttcttgctagcggaatgtgaaccaaaaagtgtagaggccaatcagtaaaaatattcaaagccagttttgttgttttcagcagttagtaactatcagtagatgaatatttactaggaaacattggtcttttaaccactttgggcatgcttcttatttagtatgttcatcatgatttagtatcatgacattcagcgaacatttattgagtgcctactgtgcactagggactagtaagcatgttaagtttgtaagctttgttgatttccaccacaaacccataggacctcaggttattctcataattgaggaaactgagattcccagtgttgaatgaaagccacacagtatcacatggccaatatcatgtgattgcagagtcaggactcaaacccagctcttaaccaccacgctatactgacggccctttcccagttcacagggaaaattcaggaacagggagagaatttcaaaatattaaagtttccccatagaattttctgaagaactttgggtatatgttgccccttggtcactaacaagttctagcagatgacagaacaaatgaggaagtagctaattaatattaatgaacaacctcagaatttttctgagtgtggaatagacttggatattcaacagtctcaaatatttgacccatttaatggac

SEQ ID NO: 1747 - DNA, 737 bp, Homo sapiens
  misc_feature (1)...(737): n = A,T,C or G
gnttgantacgatcagctacttgttctttttgcaggatcccatcgattcnnaaacttctttgtcttttgaatagtgtgcctttaatagaacacatatagcatagttctagggattagagtcttctgacttcattactatttttacagtaatttatatcttggtttcttcaattagaaaaaaaaatcgggcctgattttttatttcatttactagctcagctgttctcacacctacctgctgaattagaagggacaagtataatccatcttcttttcttctttccctccttctgtaataatgtttttctattttgcaggggtaatttttttttttttttgagataccgcttgctttgtcacccaggctggagcacagtggtgcagtcatggtttgctgcagcctcaacctcctgggttccagcaatccttctgcctcagcctcctgagtagcttactacaggcatgtgccaccatgcctggctaattttttgtagagatgaagtcctactatgttgtccaaactaaaaagtaatttttttttctagaagaagtttanaagatttagganggaaagggtggtctttaaatangcttctttttttcctggggtggggtgcaaaatcttccttggtacccaggttggaggcagtggcacggctncagcactgcanctctgcctccaggtcaagctattcttctgcctancctcacgagtggctgggatacaggngctgccc

SEQ ID NO: 1748 - DNA, 753 bp, Homo sapiens
  misc_feature (1)...(753): n = A,T,C or G
naantgaatccnttacaagctacttgttctttttgcaggatcccatcgattcgaattcggcacgagccagcattcaaaattcccatgcttnnggaatccattgggacttctccccaggatgtactgaattcaaggaagctttctctaggtgtagcagaaactgctgctgtcatgtctctgctcaccaggacgtagcttctctctacagacctttatttctttccctggaggcttcagtccatgttgaagtgtaaactccactcagctccaggaggaatcgtgttttctttatcaccaggggcttcttctacgagttgcctttgatagggaggccaggaggaagataggcccaagctcaggggtgggatcggggagcaggaagcctgtgggctttagaatcgaggtattggtttctccctgtcaccatcatccaccacctgtgtgaacttgagccatttatcgaacctcacggagccccaagtttctcatctgtaaacaaggggaatgagccctactttgtatggttgtcaagaggatttgagacaatatgtataaagcaatggacacgcagaggaagtcaataagtacaaggtaactctgaaaatgccaccaaagggaggctagggacaggaaaaccatctccgccaacctcaagaaccgtggccccgaaacttgttccaggaactgggcattgtntgaagataaaaaaaaaaaaaaaaaactcggcctntanaactntagtgnncntattac

SEQ ID NO: 1749 - DNA, 918 bp, Homo sapiens
  misc_feature (1)...(918): n = A,T,C or G
atggnnnnnnttttnnnnaaattntttccnnnnaaattacccttccaaagngccctttggggccattggtntttttgttgggcccaaggggaaatccccccnattcccggaattttcccggttttttttttaatttttttgggaaaaaataaccttttggggncttgggaacttttaacaaaaaaaaggaacttttccccccntcaacaacttttggaacaatggaattggaacaaaaaaagcctggttttggcaagtggttttccctngcancggaatggaaacaaccaaggaaacctgggggaaaggtggaagaaagaaaccctgggggaatggaaagtcatcctggctgggaatggacctggcttttcaggctgactggcccccgcccatgggggaacctatctccactggctatggccagctatttttttcgagccaggctctcgctctgttgcccaggctggagtgcagtgggtgcaatcactgcactgatcctcccacctcaacctacaagtagctgggactacaggcgtgcaccaccacgcctagctaatttctaaaatttttttgtagagacggctctacaatcgcttgagcccangctggtcttaaactcctggacccaagcgatcctctgtctcggnctnccaaagtgttggggattatgggtgtgagccaccgtgttgggccttttgcccaactattttgatgcccagacctgcttcacctttgtgtattgaagcccgttttgnaaaccgtgtgttgtggtgcctttattgnacatcctccaatnggcggttcttttttactctaatggtcttttgggttcccccctcagaagaatcatgaaatttgcaccagacctaatttttngggtacttttgggcttattgatggatttggaaaatgaaagaa

SEQ ID NO: 1750 - DNA, 1320 bp, Homo sapiens
  misc_feature (1)...(1320): n = A,T,C or G
caaannnnancntnncnancnnnatttntnatnatctaanngtgggggggntttgtnttcaaatacncnttnttttttttgcntaaanaatccnccntccaatanggtntannctananttnagncnggggggnnnttaatctntatctnaatnttcnnnnnnannnccncgcnanccccccctntatactntngattatangngcnatttcactcaatataatnangtgtaggagtgctnctcnccccccttactntttctccatatctnnctaacncctanaaatntagganacttcnatcacttctccatntntctctcanactnnatnntanccacnngacncttctgtattnnntncncnangncntnnnctntnacataacattctacncatnanacataccctatntacacctttcgctncngnctcntttntctncancacnnaatcntanancnaactttnaatancntnntacatnnnctcacatnattacgagtnacntttcttctgcaaacatatccacctntcantanntgtcatgatcttntaancanatcccgtntctctctacattannatatctnntnatttnnctctttttcnntntnctattnaantctnancnctntnnatnttncanctntnccntanannttntcacntnatcatatanctatcnaaccatatnnntcntnnataatntnnanctctcnnctattntttnncntangnctnctacnaatacncncactatatatncncnctatcananttctacactaatatntanntacacncntactctttctcactnacncacgnnatatctacctnannnnnctnttntnncnctnnttctnancactcatcnntgaccntnanacgtcacatctcancatacacntccttctctactttnacncanactacttcnanttcnctnanctnntctnntctctntctgntatcacacacactgnnantgnccgtncgactcnttcnntcatactnnctntcnaacttncnctnctaantcanctctnctnctntatatcacatnanatatatctngataacttancatcnncngntantgntntatatatccaactcanntncnccactnnnnnaanntnactntcatcnntctatatcactnaccntacatntacctcatanctncnatcntaaacaanacncnctctannatncttantacatctntncnacctcnatantctatntataatactncntnattntngtntcctantntaggtcatcnangnnacncactcnttancnatcaccn

SEQ ID NO: 1751 - DNA, 1031 bp, Homo sapiens
  misc_feature (1)...(1031): n = A,T,C or G
gnncnnnnttnaanagtgggccngtgcggnttgaancccntancctngcctgggtcncnntcngtnnnnnccgtcnnttancttcggggnaatannannggggttttcccctctttatcgnataccntnnangngggntgntnngttgtctcncncnnatantnntgttncntnccgntnagcanntattcngcncanttncctnncctcccncttcttaccttacnttnnannnntcangnntgntnngtntantgtttnntcntnnanncnnntntntnncaatgnaangctcctantctcacntnttactntgtgnnaaaangcnantatnnttcttctcnnntnagntntcntnctcnnnncnatcctcnatannncnttcatctncttcccccntgnatattcanaactccattcntcncntattnncgctngcctttnatcgtcntgctggnnntcccntctntnttnacancnnatactgtnntgctgcnatacanntacnttancgannnnnactntcntcacaatacttnnttnnctnactcnnttacnatgacgatnattnttcactctngtnctantgtctagtacnnntaatntantnnnttctcntcctaanntnctntnattgtncgntnatcttcntaggnnnanntctattncgngtcnnctacactnatctncntnactntnntacngtgnncnnnncgnacntctgcggcctngtgtcntctcatnnntnctntctnnatctncatcnttttcttcttcctanactcntncgatcancctctatntcttnatntnntcatgnngtccacgnactncccccncnttgcgnntcngatntnnccanggtcntcnatttncntnaacaggttcncttccggacatccnatatnntcnnnnntcanttcgaanttntnttnctnnttntgaanntgacnnntntatttcctgnctcactcccttactgtacntnnactnacccngatttattatnatcccctncntcntngntcncg

SEQ ID NO: 1752 - DNA, 692 bp, Homo sapiens
  misc_feature (1)...(692): n = A,T,C or G
ccncnntcnaattcggcacgaggggagctgnnnnnnnnngtctagctctcagcagagctgggagcaaagcctggccgcccaccccaacctggggctgcctcccactccgtgagatgcttctgtctcctgttcactttgtgtggtagtttcttattttcaaaatgcatctcatttgatcattactgtgaccttgggaagcagcaggacagggatttctttttagaggtgcaaactgctcagaggggacacacctcagcctctcactgtgggtacacgtggcgtgccatgagtggggaagagcaacaggcgagatgcctcattctactggaacatcactgtgggtgaacagagatttccaggttttccctcttaaaatatttgtcccacaccgacaagagtccagtcaccaggcctcaaaggaacttctgcttgtagcagccgcctcccctgtgccccagcctccttaatgtgtgcactctcagagggcacagctcgcgaggctgggtttgggggccaagtggcttgttcattccagcatctaacatcataaaggtgggcccagatttcttgattcgaccacagtgctgttcctaccacacaaatatccattcctgttttgttgaagcagccactggtcctcttgtttcccctgcaaacgganggacctgcagtgcccattcattcaacccccn

SEQ ID NO: 1753 - DNA, 1239 bp, Homo sapiens
  misc_feature (1)...(1239): n = A,T,C or G
ttntnntnagaggntgnnnttgaagcatncttaaggggnnncttttgaaagtggngntncncgnatnanngangncganccntttcttttatnatgcattgaatnaaagtttatgntnnttaccgnagnnatgtgnggggagtgatattcctnnnntanattatgattcttgtgntangnagatannattngnntgtggnnaaacnttcggnanntgatncntntnnntntncaaaataatnatcnccatantttctagnnggagaaaaaaagngtntccgnatnagtntcatatgnataangcttntntngcgggtatagattgtgtatctcntntntgncgatatangcacctgtnttccgnatactatgngtnnngatanncnntatnttacntttgaaatgnngcanactnnntngggnagtgtccntccgnaatgtnactatnacgcgntntttgganatgnactaacacnatngntntntcgcnatcgttncntattnttattgtntnctatgtntcnctgcnatncattatcntntcatcnatatnnttttactggcctcacagatttgnggtcnaanattgnntgnanactncnantgtancnganatnctannntcattntangancantnatatgtattggattggatagcnattantaataatcnggancntanntnngcgantnntacntcannaanagatantntntttatatgaaactntctggngagcgagaacnggggcantttcgtggncctatntatancgngntgttnttgcgtaagatatttacgagctncttncntgtanncctngatnacntnnanaatanacgngtnncntatatgagaagtgtnncatgtttttatantgcngtaattactnnatgnaatagatnatntgtgtaanagagataatgtgtntncgncggtntgcaacatagcatagngaatgnnacgagnngtgtaagtgnatcatatgaaatnantggtnntcacgctangttanatcgtatcncgtgnaantgtangtataaggtnatattngaattngaaacnnntatnnntatggnatnctacgtgnggggnntgtngttttantcagaggatattatttctagtgcanngtggtaaagaaaananatntnatgtatntgtangantnannnntcgatganngnatangatngtntnnanngnataggnnantcggcgtancgatnangngn

SEQ ID NO: 1754 - DNA, 674 bp, Homo sapiens
  misc_feature (1)...(674): n = A,T,C or G
tncggggncccggctttaagagcacaaggagggaaagtaacgaaagggctggactactataaaagttacaaatacgtagttagaccaatagatttatataagncaggtntttgncatgtaattnattaactaactattacagaaacacagctaanaatatcaagtatttctctggctcttgacagaaaaaaatcagttgacttaaccctttgctgtcaaaagagttggcgtttcctgttctgggtgctactgccaaacgttatggtacttagagtcgggatgcacaacttcaaccaccgacttatcaatgcagcncgcctgtgtattgcaattggccgttaccttaancactgagccacccgggtttagttcagccatttcaagaagtatatttaacgtcggtagttctgctttattaaaatgcancagaggtactcttctgtncctnccgtttatagttntctgaagagagttctattttntggnatnggtttgggttncttttgcatttttngtatcttngtatttatccctgaacatgttttnnacctttttttttnttaaanaaaaannaatcnttccgnggtttntaaaaaaaacctacgangnaannccttgaagnaaatgtggcggtcncttaaaaaggtctctgttgcngcaagggnttaaatccn

SEQ ID NO: 1755 - DNA, 967 bp, Homo sapiens
  misc_feature (1)...(967): n = A,T,C or G
tnnctntnttttagngggnttnttnnnttaaatcccctnnccatagagcggggngnttntcttttannnccnnncnnngggctagaganttcaannngnntggcgnnncnctntatncnctcccacaatanngggatgnancntnnntnnactttatnaatctcnttnntntctcnnacgngtgatntngntttagtnncntcgccgctttcncnggnttggntcnannttgtncattnnaggnaatccntttnatcnannatcatcatcncnggtnatctgttcnctcnancgncaccntnanntccnantnncttagtctcnnnagcnanantatnttnatagtnaccanatcttttncttnaanggnaatacatatcctcctnctnagaancgngnncatctaganncntnntntctccncttantnngctcctcnangtnccttataagtncnntgcntcnaaaggcgaaaaaataatttannttgnannncgtttcattnacanncngcannggtatnnnagancgnanctctntttantgnccttaccctttaaccaantctantnatatttnaanttgnaacnttatntntggggntaccnanacannatcntctcggnggttanacntgnactnnncntngtnncaagntatnntantngncatgtgnntnncttgcctagtggtnaggtattctnaaaatttnntaantcntaaatttancatgccanatggnacgtaatagtatcaanantntggtnnatttttnggnancctttntcngtananngnggggntanngctgccttcantttcannccatcanatgntttnncaaagattttatngtactctncttntanattctttanagccaannnnngaagncncngttcacttttcgnanntaagantntnncntatgnncntcttnctanaatnttctntctcctangtnnnn

SEQ ID NO: 1756 - DNA, 734 bp, Homo sapiens
  misc_feature (1)...(734): n = A,T,C or G
ccncgnctcgaattcggcacgagacctttacctgcaacctggctgagaatgtgtccagcaaagttcgtcagcttgacctggccaagaaccgcctctatcaggccattcagagagctgatgacatcttggacctgaagttctgcatggatggagttcagactgctttgaggagtgaagattatgagcaggctgcagcacatattcatcgctacttgtgcctggacaagtcggtcattgagctcagccgacagggcaaagaggggagcatgattgatgccaacctgaaattgctgcaggaagctgagcaacgtctcaaagccattgtggcagaagaagtttgccattgccaccaaggaaggtgatttgccccaggtggagccgctttttcaagatcttcccactgctgggttttgcattgaggagggattaanaaagttctcggagtacctttgcaagccaggtgggccagtaaaagcttgaggagaatctgctcatggtgcttggggacagacattgaagttgatccggagaagcttccantcattttttgcaagataccccttacttcnttcttgtttggaaangggaattngccccccaatttggtngggagaaccccaccccanccccaanggangccttgaaaccgaaaggctttgtccttggcntttgggggggggannantctttgaacaaggccccaaaaancctttttcttaccngggcttgggccn

SEQ ID NO: 1757 - DNA, 654 bp, Homo sapiens
  misc_feature (1)...(654): n = A,T,C or G
ccncgntctggaantatgtccctgcacccaaagaaggttcttttgaactttatggagaccgagtcctgaaactgggaactaacatgtacagcgtgaatcagcctgtggaaactcatgtgtctggatcatcaaagaacttagcctcatggacccaggaaagcattgctccaaaccctcttgctaaagaagagctgaatttcttggccaggctgatgggagggatggagattaagaaacccagtggccctgagcccggattccggttgaatctctttaccaccgatgaagaagaggaacaagcagcgctaaccaggccagaagagttatcctatgaagttatcaacatacaagccacccaggaccagcaacggagcgaggagctggctcgaatcatgggggagtttgagatcacggagcagccaaggctgagcaccagcaaaggggacgatttgctcgccatgatggatgagttatagctgttctgaccaggcgtcctctgcccccagggagaggctgctggatggtgacccctggggaatgccccatggcccagaatgatgctgctagttttctactgagtgaagccattacgtctatttcttatttatgttgtaaggaactgtgtgagtctcctttgaggagcactcactcttg

SEQ ID NO: 1758 - DNA, 668 bp, Homo sapiens
  misc_feature (1)...(668): n = A,T,C or G
cccnccncggaattctggtcctcccttccgagcaacgtttgcaacgatgagaggatggctgcaggaaacggcaatgaggatgactgttggaatgggaaaggcaaaagcaggtacctgtttgcagtgacaggaaatggattagccaaccagggcaacaacccagaggtccaggttgacaccagcaaaccagacatactgatccttcgtcaaatcatggctcttcgagtgatgaccagcaagatgaagaatgcatacaatgggaacgacgtggacttctttgatatcagtgatgaaagtagtggagaaggaagtggaagtggctgtgagtatcagcagtgcccttcagagtttgactacaatgccactgaccatgctgggaagagtgccaatgagaaagccgacagtgctggtgtccgtcctggggcacaggcctacctcctcactgtcttctgcatcttgttcctggttatgcagagagagtggagataattctcaaactctgagaaaaagtgttcatcaaaaagttaaaaggcaccagttatcacttttctaccatcctagtgactttgctttttaaatgaatggacaacaatgtacagtttttactatgtggccactggtttaagaagtgctgacttttgtttctcattcagttttgggaggaaaag

SEQ ID NO: 1759 - DNA, 1381 bp, Homo sapiens
  misc_feature (1)...(1381): n = A,T,C or G
aagngggaancagngnnaccacgcacannannnccnnaaggnggggggggnnnnacaccannnnnnnnnannggnnngacgngnngaaaanccccccnccnnnnnacccnnnnnannncagnncngacgggnggggggnaacnncncnaaaaacgcccntntggngannnnnnccctttaccnccccggacaannaacccagcccaggggaaagnannnacacncgannngggagnagggccggcaccncacaatanncacacacnncgaacntaacgganngcggananancgtacacaacnccnacganaccanaanncancanaaaacannancacccagncaccacntcatacntnctngnanatnatacntcatnatnctgccatatcatcncnacagtnccanggcncgngcagatccanacaatactacgcgcagcaaggnaccaacanaaatnaaaaancaaccanggaaccccccacnacacacnncgnncgcagaannnanatanaccacanctgntncanaaacnccacnnagngaaacngccagcngaantcagaaccngncaacntccacgaccanannagnnggaaccaaccaagnccagatngcnancaatannancacncganccannacaatnncncnacacnacnnngnctcnnnaacnncangaaaaaagtcatcgnncnaccacnacgngnnaaaaacnnncntacgacatataccancnnaacnngcnnnncgncnnacgcaagncnancncacnnctatngcnancctnnaancgcntgtcaatnntnacgcccngnnnacngtagacnactggancanacanacagnggngccacgttgaaanatgcgnntantacgngatgngnacacaanaaaacacnccncncagacgcgcacgacnnncacccgnggggcgnancannaaannntncgnanggacaacgncacnngntncngganaccgcantaaaantccannccaaanactangngtggacgaaaanncncgaggacananacnganacgntgaaggacnanagctgcaaangggcnacacaacgnccangctgaacanaccgncacaacangcntncatnnnngngcgcncacngacnacatcncaacgcgcgtnaaancnanaacgggnacacacannnaataanacacacgcangaaaagaaaaacnggnaacgagnngaaaaatngacccaaatatcaagnncnanaacncangcaggggcacgnggannngggacaagngaagancncggnccngnannacncgaaaggcnaganngaggccagacacacacaaaaactacatcaggaagacnaggaacnngaaaaagagaaaancn

SEQ ID NO: 1760 - DNA, 1027 bp, Homo sapiens
  misc_feature (1)...(1027): n = A,T,C or G
aacncaccccannaaaannaanacnanaaaanacatcaaaaacanacnnaaaaannnaaaaaaanaaaaannanngggaaaanaanacanaagaaangggtcaaaaaancannnacatnacnatcnnaacnncgaanntncnaaaaaccancnccnnnanaannnaggnttttnaaannncncccaaaantttttntaanacacataaaaantttacnggggggagnnataaaaaaaaataaaaagtnccccnccnatattcactcacaantccacacaacatacnanncanaaaacataaantttnaaancctgnagtgccnaaataaatgacacaaantcacaaaaaatatcanagcacnnanagnccattatcnaanacnctaaacntnntgncncaacctnnanaaatnaaaanctcncaacncatctannanacananatanataaaaaatnaacncantancaaatnnncaataaaattaaaataaatnngnnnnaaaanccantcananaatnatataagnacnnactnatatacatcattctacatcaaactaaanaaaaatccaantatnntaaaacnanaacaatncaaaacanccatacatananattnannttnanactctaaaanaanncaattctnnnatcactacaaancnctnntnncantnaccaactanctnnancancctaatcannanactntnatnnaaatntattcctnanaacntaacaaaancacnnannanctncactnnntactnaatntanactnnataancaaatancaatannncnanataannacannacacnantntnataaacaacactactacgtaanctactacacnacacatatnnctaacaaattnaacnatacgaccatcataatntaaactnnttannnantnnctnntancnactaaanatacaancannaaatntcttnaanancancnntnctatnanaaaacantaatcaatctnactacnnntaaccaatnncncatatatnnn

SEQ ID NO: 1761 - DNA, 670 bp, Homo sapiens
  misc_feature (1)...(670): n = A,T,C or G
ttatcgaattcggcacgagacagtcatcaggacctcagtgtgatacagccaattgtaaaagactgcaaagaggctgacttatccttgtataatgaattccgattgtggaaggatgagcccacaatggacaggacgtgtcctttcttagacaaaatctaccaggaagatatctttccatgtttaacattctcaaaaattggcttcagctgttctggaggctgtggaaaacaatactctaagcattgaaccagtgggattacaacctatccggtttgtgaaagcttctgcagttgaatgcggaggaccaaaaaaatgtgctctcactggccagagtaagtcctgtaaacacagaattaaattaggggactcaagcaactattattatatttctcctttttgcagatacaggatcacttctgtatgtaacttttttacatacattcgatacattcagcagggactcgtgaaacagcaggatgttgatcagatgttttgggaggttatgcagttgagaaaagagatgtcattggcaaagctgggttatttcaaagaggaactctgatgctctgcgtgggaccatgcctgactccccgaataactgaaaaatggctgaatatttttatgggtacttggatatttatttnccangagtgagcctaanactttttcc

SEQ ID NO: 1762 - DNA, 1558 bp, Homo sapiens
  misc_feature (1)...(1558): n = A,T,C or G
canggaacaatcngantnnntatnantaccncnnntgannnantnnttgnntnnanannaantnacctngngagtaanatnatnncncaancnntcactntncgatantnnntacgnttattnnantngnnaaanttnatnnanaaantaanactaatntcgtttntgggggtntaattgtaccctngataccccnnaatngggntanaaatttncaangtnnangattcgcaagcnanttantcanacaatngnaatnntaacccnnagtcnaananggggngtntnttntttntnnnnntnnannattnaccccantaacnatnnatcatcnatnantagnctnnngaatannataanncanatctncaatntcnacngtacntatatcnntantananntgtnaatagaancgaaanagntnnagaannatnanaatntgtcttnaatnnancnnanntaccnanngcggnnacnagnaantancgtgnnngantaacgacnagnnaantcnnaatcntacagtnattcacgnntgtantgctcatacgnnagcantgtcacntattatcncancncanttgnntccngaactgatcnagnnatcacaanatantanantacanatattaactgatatttncangannatttnnacncantntannactcangancntncgcngctngttgcacattanancncntaacacacatcacnatanacancancantnnatacnctcngtgcagtacntgntanctcttttcatgaagntaatgncgancntnnagaaaanancncanattctnancnaatacanngctaacatantagtataatacanatacganttncacatntgncanttacattnagagcaccgntntacacaattgttcnactgantatantnnnngcagtaacacgngctgtncntcacnngtcacnanannagnanncntnacntgtaattanntgnagctaaatcnncagnnagatanatntaantatcngncatatcgtntttntgatacannntncnntctctacgctnncgcatttanganntcnatatagcnnanncntnnctnnanaannanncgtaaatnatnctctacnttnnatatntaacgaatcntaanttnntatctatntatacanngcactatcntataatgnnacnatttntnatcgncaaaantcttntantatcnatnananantnnctngctncanattantannaacnnactcnnccgntnncaagntntnncanattannntnataaatcantgntatgatgatgagctcncaaancatcncgtagnntgntgtatacnncnagnnangtataagacnactttncacnnnactacgnatgactangannatatttntncgcngtncctcatncnangcanatccataananntggataanntttactgagatacnatctnncgattacatnacnccactacatctgtgattacaactanagnatagaaatnancncntncctattctnaatntatngantntgtgagatnc

SEQ ID NO: 1763 - DNA, 682 bp, Homo sapiens
  misc_feature (1)...(682): n = A,T,C or G
nttcnctgactnannanctncacaacactgntancttgactgtanctatgtaataacattagatcccctaattgtaattatattgggtttgcacagaacactttaatcttcccctcaccaatgtgaagtgaggaatcaggagtcaaactgtagaactaaaatttgacttcagtctagcgtttccttggtgtttttaggttgctttggtaagtttaggtttgctatatttctgattgcttagaattttgttttagccctttaaaatcagatcataaatatgaattcatacttctaaggaattttcttgctataagctggagtttaggtgatgtataggttcagttgagacatttttggaacaggcaaatccttagttaacataagatatttaacagttgaagatagtgtcatggatttttatcttttttagcaagtaatgctaagaaccactggcctgagctactactcttcagtatacattattaggattgcatagacttactagaggaacagtttcaggttttgatgctaatcagtggttgtgtcctaaagttgtcctttgtgcctttaaaaaggtttggatatatcttctangtttaaaaattgcttattaaggaaattcattttantaattgcaggtggggaaaagtnatgggtcaantaaccactagggtaagactat

SEQ ID NO: 1764 - DNA, 678 bp, Homo sapiens
  misc_feature (1)...(678): n = A,T,C or G
antaacgaattcggcacgaggcanngtggtgactaatatagtaaatgtctttatagtaatacgtgagtaatcattaattctaaagatagaattattattacaataaacaaactttagtcacatattggcagtttttctatttcaaacacagcaccagagatcagagtctacttgaaacttacatttgtgttatttaacaatttttctgtatctttttcattggtgttttgttttgtttatcttttgtttttgtttctttggtttggtttgtttttgttttgttttttgagatacgatctctgtcacacaggctggagggcagtggcacagacatggcccattgcagtctcaaactcctgggcttaagtgactcttctgccacagaagatgaggaagaatacatttttcatagtgatggggtctcactatgttatctaggctggtctcaaactcctggcctcaagcaaccctccaccttggcctcccaaagtgctgggactatagacatgaatcaccacactcagcttccatgtctttttatgaactanggttcctaattaatcagataaatttggtattttcatctcctaacttgccatatgttttctgggaaatcttataagcagccgagagtggnggctcacgctggaaatcccancacttttgggangctgangg

SEQ ID NO: 1765 - DNA, 1415 bp, Homo sapiens
  misc_feature (1)...(1415): n = A,T,C or G
ctnntaatatacnnanancaactncnantnnantattttancntaanntgtnncactatntaananantctnnnctnaanacaaantnagtannctttgtanattcnnggnaatctctttnagaannnatcatntnaagtatatcgnacnagctcattaatatnatngaantcatnacannagaataatatcaannactaaatcaacacncncaanntaatatcgaattcgggncgaagannaaacgcaactaggncacnccgggnnggngnagaccntacaaaaaanatannaaaaaataattaataagcccancttgancctnattangggggnnnntttataaaaaaanctntnnnccancanacatataacntnatatanaataaattnttacttanaatnatagnnnantatnnctatnaggnntanataaanactnaattaacnnanaatttnanattagagnagaaantcataaanacattaananncgactanctcttnaaagtnngtnaanttgntananncatnnancntatactatatnctatnntcctntaatncacagacgtnttntgagantnnnnttcnntnatannntattctnattcagantngcgnattatatatatnatnataaactataganntcatattatcacanattaaatancgcnntcctcagatctgctncntcttataanttntnganataagtacnaaatacanatacactntnanagtcttaaatatcaatangaacaananttatatatatagtacacggtntcttatatnataanantanntctcntattaanntctcnnnctactatatntcacnnaaannatcanaatcgaanacatnttnntattactnctgntnngntacnnnncaatgtcaacantttnatacnnccannaaatctttctnntnaatngncngantatacntancnnaantantctnngtagtttatancaaacaggacaanccattantaaaanctntnatnanatnncatantnctaaanatatatctcnnattananacatanaatanagataanntnatnatcnttaancanantattanatantanaatanntnaatcntnaantannacnttntcctctactancnnctctntntttaagctatantgagttcncgcacntatntcggatnctancatctataacatattaataatatnnatatatatnnagttctgtaacactcacaanacgcgctnanncgaaannncagantatatanacatatcaaacnntannattatcttctctntatattctntttacacantctancntanttntctanaannatcatnaacaattgttgcgactatcatacantcataatcaccaancagtcacggngagngcn

SEQ ID NO: 1766 - DNA, 673 bp, Homo sapiens
  misc_feature (1)...(673): n = A,T,C or G
tntcacaatgtgggaactgccaaaccaaactgcacgacatcgacggcgtacctcacctcatcctcatcgcctcccgagacatcgcggctggggaggagctcctgtatgactatggggaccgcagcaaggcttccattgaagcccacccgtggctgaagcattaaccggtgggccccgtgccctccccgccccactttcccttcttcaaaggacaaagtgccctcaaagggaattgaattttttttttacacacttaatcttagcggattacttcagatgtttttaaaaagtatattaagatgccttttcactgtagtatttaaatatctgttacaggtttccaaggtggacttgaacagatggccttatattaccaaaacttttatattctagttgtttttgtactttttttgcatacaagccgaacgtttgtgcttcccgtgcatgcagtcaaagactcagcacaggttttagaggaaatagtcaaacatgaactaggaagccaggtgagtctcctttcttcagtggaagagccgggacctttcccctgcacccccgacatccanggacggggtgtgaggaaaacnctgccttccaatggcctggacnggatgtttncaaactnttggtcccctacgtctcaacaggcgctnacttgaagtgnatgaatatt

SEQ ID NO: 1767 - DNA, 694 bp, Homo sapiens
  misc_feature (1)...(694): n = A,T,C or G
gnnccngtagangnaattatcatgtttccagtccnagtattcttttttgttccacaaatcatagatgtcaccattgaaccttctgaagagcctttatttnctgctgatgaattgtatggaatagttggtgctaaccttaagaggagctttgatgtccgagaggtcattgctagaatcgtggatggaagcagattcactgagttcaaagccttttatggagacacattagttacaggatttgctcgaatatttgggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagcccggaaactatgggatgtgttggcaagaaccgtatagccccaagatttctctacatttgggccaaatgctcgtatctcaattgatggggagggagaaccaggcancccaatgtggttggccncgataaccaaanggacccaaagaaccccgggaaaggaaancaagttcttccagtgcttgattgnaaccg

SEQ ID NO: 1768 - DNA, 675 bp, Homo sapiens
  misc_feature (1)...(675): n = A,T,C or G
tttcgaagatgaagaagttctcttcctgtagaaaaagtagatgttatcatatctgagtggatgggctattttcttctgtttgagtctatgttagattctgtcctttatgcaaagaacaaatacttggcaaaaggaggctcggtctaccctgacatttgcactatcagccttgtagcagtgagtgatgtgaataaacatgctgatagaattgctttttgggatgatgtctatggcttcaagatgtcctgcatgaagaaagcagttattccagaagctgttgtggaagttttagatccgaagactcttatttcagaaccttgtggtattaagcatatagattgccatacgacgtctatctcagatttggaattttcatcagattttaccctgaaaatcacaaggacatccatgtgcacggcaattgctggctactttgatatatattttgagaagaattgccacaacagggtcgtgttctctacgggccctcagagcaccaaaacacactggaaacaaacagtatttctactggaaaaaccattttcangttaaagcaggtgaagccttgaaaggaaaggtcacaggttcacaagaataagaaagatcccccgttctctccccggaccctcacgttgaataaattcacctcaaacttatggncttccagtggaaacn

SEQ ID NO: 1769 - DNA, 661 bp, Homo sapiens
  misc_feature (1)...(661): n = A,T,C or G
ttntcgntnnnncnancnanaaaacatctggtttttgtggcggggcgccctgctcctggcagactacatcctgttccgacaggacctcttccgaggatgtacagcgctggagctcggggccggcacggggctcgctagcatcatcgcagccaccatggcacggaccgtttattgtacagatgtcggtgcagatctcttgtccatgtgccagcgaaacattgccctcaacagccacctggctgccactggaggtggtatagttagggtcaaagaactggactggctgaaggacgacctctgcacagatcccaaggtccccttcagttggtcacaagangaaatttctgacctgtcgatcacaccaccatcctgtttgcagccgaagtgttttacgacgaccacttgactgatgctgtgtttaaaacgctnttccgactcgcccacaanattgaaaaatgcctgccagccatactgtcggtggagaaaaaggctcaacttcacacttgagacactttggacgtcacatgtgaagcctacgaataactttcgcttcttgcttcacccnctggacaacttacaaatggnagctgcctttttggngganccccgnggaggcctccttccccagtctggttacaaccccttcacaactggactntga

SEQ ID NO: 1770 - DNA, 676 bp, Homo sapiens
  misc_feature (1)...(676): n = A,T,C or G
tttcatggaattacttttcttctagantantanctntcttnccactctcacttgaacccactccaaccaggcctccccatctccatgaacctgatcttgtcagagtcacaaggacctccacgatctccacattgctaaccaaatggtcaatgttcagtcttcatcttattcagctcatcagcagtccataacttcctcttccttgatgcatattcttcacctagcttccaaaacctatacttctcctggcttttctctgccttaccagtaatgccttactggtctcgttgctggctccttctcttctgccccactttatgcacagaaatgccctagacctgccctttctctacctatactcaccctctactgcttgtgagcatcttgcggtcagctctccacctacccagccccctgcagtttgagctcaatacctgtttgttgaagtgcactgagtccggaaagtcggttctgtcagtgagcttctacagaaaggaaagcctttgaaaattttttttgagaaaagaagacggggcaagaangggggcccggaataaaacactgcactcncttccnananaaaaannnnannnnnnnnntnnnnnnnnnnnnnnnnnnaaanannntnannnnnnnnnnnnnnnnnnnnnnnnnnnncnnnnnttaaantntcncg

SEQ ID NO: 1771 - DNA, 636 bp, Homo sapiens
  misc_feature (1)...(636): n = A,T,C or G
ccgttcctgatggagctgnanagccacccacaaacaaactacccattttcttttttggaactcatgagactgcttttttaggaccaaaggatatatttccttactcagaaaataaggaaaagtatggcaaaccaaataaaagaaaaggttttaatgaaggtttatgggagatagataacaatccaaaagtgaaattttcaagtcaacaggcagcaactaaacaatcaaatgcatcatctgatgttgaagttgaagaaaaggaaactagtgtttcaaaggaagataccgaccatgaagaaaaagccagcaatgaggatgtgactaaagcagttgacataactactccaaaagctgccagaagggggagaaagagaaaggcagaaaaacaagtagaaactgaggaggcaggagtagtgacaaccagcaaccagcatctgttaatctaaaaagtgagtcctaaaagangacgacctgcagcttccagaaagtcaagattccaaaaccaagaggcagacccaaaatggtaaaacagccctgtccttcaagagtgactcattactgaagaggacaaaagtaagaaaaggggcaagaggaaaaacacctaaaagcacctaaaagngaaaaggccaaaggaaa

SEQ ID NO: 1772 - DNA, 906 bp, Homo sapiens
  misc_feature (1)...(906): n = A,T,C or G
tntnnntnanantannnnnnnancncnntnnnncnnnnnannnannttnnancntnnnnnnnnngannnnnnnnnntgganattcatnatncancattcnnnnncnnntnnttccccccnccccnttccccccccnccntcnnnnntnnaaantttttanaacaagggggcatantatgaatgctacncnccctgtagattctgaaaagttggccatgttagaggaagtatttgtnagccttgaaatctccttcaaaagngaatattgcatctgtcttagaaaattaccatacagagtctaagattgatcgagacaagtcttttatacttgaggaacacatggacaaaataaacagttgtttttcagccaatactgtggaagaaattattgaaaacttacagcaagatggttcatcttttgccctagagcaattgaaggtaattaataaaatgtctccaacatctctaaagatcacactaaggcaactcatggaggggtcttcaaagaccttgcaagaagtactaactatggagtatcggctaagtcaagcttgtatgagaggtcatgactttcatgaaggcgttagagctgttttaattgataaagaccagagtccaaaatggaaaccagctgatctaaaagaagttactgaggaagatttgaattaatcactttaagtctttggggaagcaagtgattttgaaatttttgagggtgacaggcttttaaagggataattttgtancattggnttggcaatctacaacatgtgggncaaattccancctggctggctggttttaatatacccctgtaagctaaaaatgggttcccgcatttttaaantgggtggggaaaaaaaaatcaaaagactaattaatttcatggaccgtggnaanttatcn

SEQ ID NO: 1773 - DNA, 734 bp, Homo sapiens
  misc_feature (1)...(734): n = A,T,C or G
acnttntcgaattcccacgagagcacaagtagatgtaaaaaanaaanaaaaacccccccccngnggaaagaccctntttaggtttngtttngtttttttttgggtttngttttnggtttttttnnctntnggnaaacccnngccaangggccanancncctatccngattttttnntnagggcccntttcnnaanaatngggtcnaccnggaaangnaaaagggggggggggggggnaaaaaaaaaaanctnnggcnttggnggntttaaaaaantttannnccattngttncaaanancncaannttnaaaancaaaaaantcncnccccaancaacccaaattttaanngnncaaattnggcncccnaaaaaaacccccctnncntnnnttntttnggggcantnttnancccccccaaaaaattgncccaaaggggtttaaaaaantaattttccnttaaaggtaaccccttccccccaaaacagcaannttnnggnncttttttggatggcaaccnggatanttaattgttcaaccantttganaaannanccntttggaacctgaaaaaaaaaaaaaaaaaaaccccccccctttaaaacttntggggggggnttttnccggaaccccacnctnnaanaaaanntttgggngggttggggnncnccccnntnttanaantnnnnnnnnnnnnnnnnnnnnnntnnnnnntncnnnnnnntctnnnnntc

SEQ ID NO: 1774 - DNA, 536 bp, Homo sapiens
  misc_feature (1)...(536): n = A,T,C or G
gnnattanatcaactacttgttctttttgcaggatcccatcgattcgaattcggcacgaggtcctcagggaaaatggaaaatacattcccaaacagtctttcttgacacgaaaatattatttcaacaacccagaggatggatttttcaaaaaaactaaacggaaggtagtgccaccttctcctatgactgatcctactatgttgacagacatgatgaaagggaatgtaacaaatgtcctccctatgattcttattggtggatggatcaacatgacattctcaggctttgtcacaaccaaggtcccatttccactgaccctccgttttaagcctatgttacagcaaggaatcgagctactcacattagatgcatcctgggtgagttctgcatcctggtacttcctcaatgtatttgggcttcggagcatttactctctgattctgggccaagataatgccgctgaccaatcacgaatgatgcaggagcagatgacgggagcagccatggccatgcccgcagaccanccaaaaaaaaa

SEQ ID NO: 1775 - DNA, 1014 bp, Homo sapiens
  misc_feature (1)...(1014): n = A,T,C or G
nntacgatccctattntngaaaatataatttgacaaantccttncncttcttnnanactanngngaagggtnantganggnnttccnactatagtgtggagntcctcnccctgaggtgggtacagaaatcaattgccncctnatgggggttnanaataaaaatagtggngcacaagcncatnggtnnccaaancccttcctanaancacaanncanncgacnngccacaccccgatncnttncntcacacnnatnnttccntaanancanannntcnannncgtcanctctatctaaaaccatnctnttaacatcttnctnaccnantnntcactnaaaaaanccaccacgnanncacgtttanaaccccatctnaantgnactctaacaccaatnaatantaacaannntatnntttcntctcnctananaatatnccatcaattctcnnnaactncctcantnnacatactantctnnagacnttatacctatttntctatacttncccactntancttatcanacncaccattctnctcntctccttacnnntatatatcaanancacatcttacnntcatcacggcactanatanccacntcacnacctctcaccatancgacntatccnattaantaacactccgagtncaacatnccgcnaataaaagaataccntctgaggtatcttattanatatttatcacatnnctacgcctatccnacnntcgnagcataccccttntatnntngnntcactnctataatnccatcatctaaacncnnnatcttacactcccncaaacnaatcaactctatntnannnataatatnanacacacnnnnactctttttcctncntaattctnaacatcnnctnacatgntacnnctaaanactctnaactanagacccctntactactncacctctncantntacacaacctatctntactcncagctcacctgnnataacnttactttctnccatcttcttataactcttncg

SEQ ID NO: 1776 - DNA, 716 bp, Homo sapiens
  misc_feature (1)...(716): n = A,T,C or G
agttccttggctgttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtcaggcagttcctgctccgactggggctcctccaggtggtcagccagattatagtgcagcctgggctgagtattatagacaacaagcagcctattatgcccagacaagtccccagggaatgccacagcatcctccagcacctcagggccaataataagaagtggacaatacagtatttgcttcattgtgtgggggaaaaaaacctttgttaaatatatggatgcagacgacttgatgaagatcttaattttgtttttggtttaaaatagtgtttcctttttttttttttttgaaatggccaaannttttatccttcntgatggggggttantttttntgtgaaaaaatnaaaatggnttnnttttnanatttaaggggaaaggccncntcccccaaaggntttccaattntggggtggagccttnggaaaaaaangccttttncaaggnaccttcccctttnaaaancctgttttgggctttccaanaanggattgnaacctcaaananngnnnnnnnananncntttncctttcccn

SEQ ID NO: 1777 - DNA, 928 bp, Homo sapiens
  misc_feature (1)...(928): n = A,T,C or G
cnnaagactntttggaaaacccgtnctttttgcaggatcccatcgantcgaaanttggaccgggggaaggnntacnggnncccagaaanttttttttgggggnncnggggccnngnaggggggggtgntnnnttnnaaanttnnaaaattttccantntngggatgggganntngggattnggttttntcctngggcnnggccttaaggaaaangtggaaaatggccttaaanantccnnggccttcttaanaggagcntttaatttnacagnggcaaggggctggtnntgganaacnggttgnggctntgaattntttaatatacccaccnnnncnttnggcttacactgnacaatnggagatgttggtacagggtccctgagatgcaatcaagaattaagccgtagccnaggcatttggnccaatggggnaaaggttcaaaaatnaaattttattttttttttttccccttttttnccccccttaaccccccaattccccccaggnccnaaagnaaanttttcnttttttttcnaaaggaaaaatttcggggccaattccnantttccntttaaaaaaccnaaaccaantttcnttttnaaaancccccccccaagggcttnggggggggttccccccccaatttttttnaaaataagggaaangggtccaaattnggggntttcaaagggtctttaaaaccgggggggccccgggggnagggggccctgggtttttggangggggnaaaaaacaantttaggtttttgggaaaaaaatacccccgggttnccccttttaattnccactgggnccttgggttctttccaacgtnggggaaatggtgcctttggggggnccccttcannaaaagaaaagtctgggtngggcttcctaaaggggttggggggngggggganacaacct

SEQ ID NO: 1778 - DNA, 1173 bp, Homo sapiens
  misc_feature (1)...(1173): n = A,T,C or G
cgaatcctttgcaactacttgttctttttgcaggatcccnncnnccngaggcannnnaggnggagnngacnagngncangacgggnnttntaattgatanaanaagcccccgccncacgggtntnnntnngggccggggccnanngggcnatnngccaaaaanaataactccaantnccngnnagaacatgacccggaccatcnaanggaaaatgaaacnacacaaanccagactcnaccntggcncanccctcnnagaagccccaagantcnngnnccnngcnncggganccgagnttacnnnngaangcgggnnaacnngngcccgnagccccaaggcntgncacgtggcannnggctncnnnncaaacaaaaancaacccgnaagnnctccnanannnncncccangannncnaaanccaagntnctnncncaacccttanagccccccnncaaaggncacgcactggngggaactccaaggggncganggnngnctcttncgacacccnanngcacccnacncnagnannancncgaggnctatcncancnttggggnnanaaggnagcacggcaacccnctagnanaaaangnanncanactnncanannccnngggtatncacnccaaanactcacccgagaccccntcnagaagcccaatnccctaacacantgggngcanaccnaaccnncgtacaacagcncnacgnaggggctcacggganntntnggaannganaggcacagngacncgcncagtntggngcccacanccngtaaaccntntanngntggngaggcnncgcgcatacnggananccgacttncncaccactnnnctntcggaatcgnaacgccctancacgncaaccnnggcnacnnncnangggaaananagnggganncacccaccaccggggannacnnacagnttatcgcgcncgcnacattgggnnaggngnntcacnataangcccaccctcncncnatactcacagtncaatccntacacaggncanngcanaagnggnaacngaaatgcgacncagnccganncaaaanggggggggggcaacnggcacanaaagcggnganacccantaangnggnnccnncaccncgnggataataatactntngnaggtacacacnnaaatncggnaaggn

SEQ ID NO: 1779 - DNA, 728 bp, Homo sapiens
  misc_feature (1)...(728): n = A,T,C or G
agnttttcnattcgcacganataaaatnnatgnggngngganaaaattntaattttgaaaaaatntaggaaagttcctaccaaatatacatgtataaagtttattaaaagtcataatgacccaggaatagctaatgacacagaagtagatcaaaatagaacacaatagagaacttcaaaataaaacaggtgtgagaattgtgtgtgtgaaaaagctgggttcaaataagttggtttgttagacattcatatgcctactcatcagccatttcgttctcccttccttgctgacaaagccccattttttttttctttttttttggcctaaaactctgtatggctgccttgtgctatanaatagggtgcttccctagcctanagagggtgagtgttgattagattctgtgccaatcatggtaattggcttacttgatcatttgatggaatctaggctaacgagacaaaggaagtctgaaggctttgaataanaaattttctgtgctcttaacaattgatacaagttagggatttgccagcatccctcttctgcttctcagtgaanatatgtgatatggatgtttgaagctaatctgcacagccttctgatggccatgaaagggacaagtntggagatgaaaagctntcacactgganaatagngggatgtaaaaagaaaacncctgaattgggcctctgaattaaccaatcccaggaactggtttcctttgg

SEQ ID NO: 1780 - DNA, 685 bp, Homo sapiens
  misc_feature (1)...(685): n = A,T,C or G
nnnactatacgatncctattntanaaataggaccagtagcataggtgagccctgagcactaaaaggaggggtccctgaagctttcccactatagtgtggagttctgtccctgaggtgggtacagcagccttggttcctctgggggttgagaataagaatagtggggagggaaaaactcctccttgaagatttcctgtctcagagtcccagagaggtagaaaggaggaatttctgctggactttatctgggcagaggaaggatggaatgaaggtagaaaaggcagaattacagctgagcggggacaacaaagagttcttctctgggaaaagttttgtcttagagcaaggatggaaaatggggacaacaaaggaaaagcaaagtgtgacccttgggtttggacagcccagaggcccagctccccagtataagccatacaggccagggacccacaggagagtggattagagcacaagtctggcctcactgagtggacaaganctgatgggcctcatcanggtgacattcaccccanggcacctgccactcttggccctcagcattattccatttggaatgtgaatgtggtggcaaantgggcanaagacccccctgggaaccctttttcctcantagtggggagactanccctaggtcccacttggttttatatctgaccanacagat

SEQ ID NO: 1781 - DNA, 1230 bp, Homo sapiens
  misc_feature (1)...(1230): n = A,T,C or G
ccnccccnnnnnnnnnntnnnnnnnnnnnnnnnnnnnnngnnncnnnnnnnncnnnnnnnnnnnnntnnnnnnnnnnncannnncnngnngnnnnnnnncnnnnnnnnnnnnnnnganaggngnnngnnnnnnnncnnntngggannnncantntntgangtnntntanngnnntcntnnnnnnnnnnnannnnnnncncgccgccncncnnannanntnncccccnctcntannnnnnnnnnnnnnnnnnnnnangntancgaaantcngcacggnggtattcatcttcttgttntnctgccggtcncaaggctaacccccagnatngtagntggccttaatatcaggtnngacngtgtgaaatgttntanggggtttttcaagaggaaaagttntaggcttaaaactgactggtaaaaanagaatatttctttgtatttgatttttcagttatatgctngtnccagccagttatccttcngtnaggtgntncggtttgtaanaactgcncacatttggnnanatntcgncgccgccttcatttgncangaacnnannnntcnctttgggttnccccaatccccnaacttgttnaaaccatttggncattanaaancatgtcctggttntaaccctgantttttacntnnnccggcnnnaaccaaacntntattcnacntggnangtcnnctttagancttcttctncccgcantgaaaanaaccgggngnntggggtntgananctatatagggggttcnttcntggccccttcaccgggnggtgaanctcgancttgaaagagcccccccncatatanctntncnnnaggngggggngnttncgncnntgaaaactatnccacntcctnttgnngnngtngctngnnntnnacnanatcgnngnnttgngnnatgcgnnacanccatngaacccncncaacnnctcngtatttatanctcntncacnngntctancctcncgnctcnttnctcccaggangnaantctncagtananaanntccttngntagnancannngnnatctcnggtancctancnnggggngggaagacntctttgntctgctnattanacaaaanatatanacacngccgcgnttcttnctaaaantctntagcancgaggctccctntcaantanaggcgtcacctcntcnaactatacnangggngcnactntcccctgncgcangcatctntggcca

SEQ ID NO: 1782 - DNA, 1450 bp, Homo sapiens
  misc_feature (1)...(1450): n = A,T,C or G
tnnttgntannnnccncttnngttnntnttnntngcttnannncnttcncncntcntnnttttnntnnnnntnnnntntnnnnnnttcnnttntacntnanntntngntcttgntntnnnnntangngagtggnntntcntctcccntttngcatatctatntattctntnntnnntnngcccnccccctccnttnnncnccccccctnttctcntnnnnnnnnnncannntgaacagnttgnggnagggggctttctttntctccnttnggncccccccttttgttttttnttcctanntnntntanatnnctggtatgttttncggggnctcntcnttttctantnnngggggnnttttttacctttattcttccncccttanctntcnnantctccnntcnnttnncactttctntctccatntantcttttgtnntntttntttnnctcgacattcttcttttcnctatatnntntcttntctntnttctctattattntcntnntanttntcntcatattttatctncnttanttactctcgagtctntnactntctttcttgttctncnnttccatnttcctatcctttanttnncatnnncnttacttntnttnnttctntgnttncncttnntnctctcttttancntncncttntnnttnatattttcnanctaantnactttncatncngtttattncnncnactntgtnttttnttcctttnttcntctccnttctntcnccttntccntancgntcgtcttctntntcttntcctnnncttnnatcntctctatatctngtttattctctntcnccgtcattagttctctctnttctctcttnnntccntngtttctntatatantctntcctntntntactntacnnatntcatctttcntncactttctcgctcttcacanntnttanacngttctntntttctcnataccntnntcntcgtnttttctantcccntctntatancntctgttcanctntattgtatctcttatttttagctccttttntnctnatnctctccangtntnntctatctanncnctccnctcacntnnctttntcatnttctccctctntctatntatntcactatatttgtnntacgcttctttnttcttcctacactcnngtttttncntctttacnctcntcttcnttnttgcttctctcttcttcnatnctccnctttcgcgctctcntncctnngatcattctcntgctcctcntatatctnttctcactatctccatnttacttgtctctcgcntgtntcagtcttcactncnntactcttnnattnctccacttttattntcgcatctcctatntatctcgctnntantctctntcttttnatnnatctcttcttttatntncgtagtctctcntntcnnttctttntacttctcctncn

SEQ ID NO: 1783 - DNA, 700 bp, Homo sapiens
  misc_feature (1)...(700): n = A,T,C or G
aaatcgataaggaaaancgtgaagtcgatagaaatgaaggcctgaaatttgcacgaaagcattccatgttatttatagaggcaagtgcaaaaacctgtgatggtgtacaatgtgcctttgaagaacttgttgaaaagatcattcagacccctggactgtgggaaagtgagaaccagaataaaggagtcaaactgtcacacagggaagaaggccaaggaggaggagcctgtggtggttattgctctgtgttataaactctttaactgctattttagggaccttgcagtttgcacataattgttttatatcatagcagtaaatatttgcaagaaatcccactcatcgaccccgggtaaaatgttatggtaagcatgcacagtttgcagtctacagtttttttatgtagcacaaaataggtgtacctttataagtacattcaattttatgatttacatttatcatgtaatttttaaaaaaatccatctatctaggatatgttgatacaaagtctgcttttgctattctttttgcttaaatactcctatcattttctgaattacttggtatttaaaactcctagcccacggggaagaatagangtatcatcaaacgtggcaaattttctttcaggaataataaagagcatgattccccaaaaaaaaaaaaaaaaaatccgncccttaaaactntagggngcgtt

SEQ ID NO: 1784 - DNA, 1144 bp, Homo sapiens
  misc_feature (1)...(1144): n = A,T,C or G
gagnnacantgnggnactnntcnntttcnttttttgccaaaaggaccagtatcataggtgtntcttgagngngaaaangagctatttcctgggggnttcttcnctatacagcggagntctgtccctgaggaggctacaatanncnaggtcnctcnnctntgcaagaaaataatactngtggganccgatanncttnnnnctngnaatgtcctgtctcaatagtcccanagaggtaaaaaaaggangaatttctnntnnactttatctggncatnngaanganngnaatnaatncanaaaantgcnanannttaccntcttgaacngggngancanccaaaatantntatttnttactcggngaataacnntttatngnctcttanaagccanatngnttnnggnaatattgnggggtnaccttnccacannggnntaaattcacngngtngnncnaanccccttnggnatctttnncctcnacnnnncgcttnggncaccnantatnntccacacttaattcttggtaannncttnttccggcagnntctatacgtnggctntntncnttcantcgcgatanntnncactttntttnacttctcnnaatnntcanactancncnctaatacttttaacgagnnganacactaantgtntttatcgaatntntnaaatacgtannatctttntctttatcactcatatgnntattttntacccccngtntnatntntcntncctntncnccccccgtatgantcaccctnnatctattcggcaactttacatcnanangtntgntgtccctnctctatntaanaaacgnnctcactacttcatcccaantannnncattccaccctcttagtnaaanntntnttngataaaatatgcttgnggtgncgggtncacaaaaaanatgtttngnggtccnaaaaatattantaancccccccctnaccnccngtgtgtnttnaancactntnttcattttctgcncccatntctcnnctcgtatnnatcctatcngcggnnctantatctttttagtaggtancanctnntatggtctntctctngantcactcantgggtgactancnntaatttaattcnnncgngcncntctcccnngtntnnnc

SEQ ID NO: 1785 - DNA, 702 bp, Homo sapiens
  misc_feature (1)...(702): n = A,T,C or G
atgcatctgagaatgatgagcgcttatctaacccccagattgagtggcagaatagcacaattgacagtgaggatggggaacagtttgacaacatgactgatggagtagctgagcccatgcatggcagcttagccggagttaaactgagcagccaacaggcctaagtgccaggttccctggcgttggtgacatgctgcagcctggaactctgatctccagtgtgactgcaaagctgtcttctcactggtactgccttgtgagtactggttggactgtggggcatgtggccgctgcagttccagtggttatttctaagtctatgacaggacaggctgttcttgcttcagaaccttctctgacagacacggtaactaaatgtgaaaaaccaataagctggtgactcatgaatacacacgaggaaaagcagaggtttattttatctgccttttcaacatttctttccctctgtgaaatgattggtcagatgtctttgagaagtgttaaactaattcacatggtaagtgtagggccaacatacaaagctacccagtctaatgtgtatagtagactttggggaaaagcgaatttttttcatgtattcattctgaatagttgaaatgtatatttgtacagtcttttagacctattcaagtgatgctcatgatcctgtactggngtgcccatcataaattctttttttta

SEQ ID NO: 1786 - DNA, 723 bp, Homo sapiens
  misc_feature (1)...(723): n = A,T,C or G
anntttcgcattttttgcctttacaaaaaggcattttgttatactacagtgtaaacctcatttttttcactccaaaaggtagcagcccctcttcttcccaccctggacctgcctttcactccctgggcacagagcgcatggtaccattgatgtttggtttattccaggatccaaggagctggttctgctggttggaccaaacctcgtgagccagccacccctgacccaaatgaggagagctctgattctcccatccgggagcagtgatgtcaaacttctgctgctggggaaatctcatcagcagggagcctgtggaaaagggcatgtcagtgaaatctgggaatggctggattcggaaacatctgcccatgtgtattgatggcagagctgttgcccacaagcgccttttatttagggtaaaattaacaaatccattctattcctctgacccatgcttagtacatatgacctttaacccttacatttatatgattctggggttgcttcaaaagtgttatttcatgaatcattcatatgatttgatcccccangattctattttggttaatgggcttttctactaaaagcataaaatactgaggctgatttantcanggcaaaacatttactttacatatcggtttcaatacttgctggtcatggtacacaagctttttacnggttttttgtacaatnaatattttgagtnaaaaatgggtacat

SEQ ID NO: 1787 - DNA, 763 bp, Homo sapiens
  misc_feature (1)...(763): n = A,T,C or G
nngantcnnnncgagaaaagtctcccaccttttctcctnnaactnctctcctttctntccataaaaagaaaaggaaaggaacaaaagaaaaacattcagtttttctttttctgaaaaaggtaagtcctttcctgaagtcatcaaatgaaacattatctggaaattagtttctaatgttgtatatgaagaaatacttanatataagttcctgcagtatttattagatagttgtacctgtaaactcacctccctagtanataagagtttcaggttaaatactggaacatatataggcagtcaaaaatactctttaaatgtcattcacctatttaaagccatgttttagcactttttangccaaagaangtctgatagtgcctgtttttatgttctgtactctcacaaactntgttactcaaaattatngcatggcangagagattggattatttatttcctatatctttataaagtaaaaaaatctttctaaacaacaaatcctaacattattactggattgtttcctaatttatcctccctnagttgaatgntaacaaagcttttccagctgaatggaatgcaccttanctgataaaccagaatttggncctttnttttccctnccttttntttttgagacaggttctcactctntnacccgaaggtnngagtgcannggttttgatcataaccttgactgnagccttcaaccttntggggctcaaatggatcctttcacttaagcctnctggngtangttggg

SEQ ID NO: 1788 - DNA, 1024 bp, Homo sapiens
  misc_feature (1)...(1024): n = A,T,C or G
gnttaatacnanatactcancttgctgcctgcaggtcccatctntcgaattcnggcganangntgggaataaantgccttgnggattnnnctccattgncnntttggcaccnaaangtttttattcnaaannaaggaantttagttcttgtnaatncaagcttgnaaanaggcccncactggggtggnccaattgcatttaacttgcactgaatccttnttccancttttgcnttgnggctgcttngatnantgaggganttcaantaatttgangcnctaatggtatttttnaaattnggacnttttttggancccctaagtaatggattgaataatcntngagcaagggggaacaattgccttgntttatnnngtgggggaacttcaanggnnnnnncccccaacttgggacctcaatttttcaactaatgttttncaataannttttgaaaaaaaaaacctgnngccntntttttggngggcaagggaaaggnncttttctnttnnggcttggnggaaatcaaggcaattccttgggtnccctggggaaagccttggtcaaaaacanttaaatncgggaaaaccaatttttctttttccaanaaantnnaaattggnttgggtaaaagtttntttgggnaaaaaatttggaatntggtnccaaanaaaaaaanagggnaagtttcanaataanncatantttcaaacaaggtttttnttntaaaacnaanaaaaaatnggntnaaaaanaaaatannctttcanttttcaaatttttagggaaaacntaaggttccccngggttcggggggttttaataacctttttttgacttggcttttttaaanctttagcccccttttagannanggcccaaatgccnnggtnggaagnctncaaanngggcccggattatttttttgnaccaantntntgtgnataaaaancttggggnaaaaattcccttaacntttacncnaaaaattttggcttntttttaaaaaaattggnaaantntgntn

SEQ ID NO: 1789 - DNA, 700 bp, Homo sapiens
  misc_feature (1)...(700): n = A,T,C or G
ttanatacanctacttgttctttttgcagtaccctngattcgaattcggcacgagccctttgagatttctggctttttgtagggacctcagttccattttcccaactcatgggttctcaataccttaactntctnttatttgtcaaattccaantcctcaaaatcncccaccattacctgacccnctggnagtcaccacaccaccttncccactttcccagggatgcttatgnattagcttaaatcctcaccattctgatttgtaatgccgnccccaccccctttttttgacacctgggagttancttnnctttctggnaagatcancntcacacanacnagcacattttcttatnatactttatctagaaaacccatgtgtcantggcagaagcatcctgaattntggtagancattgnntcgctggactggaacctcctgaaacacagcagtgggaattgcttgtaatccgctgngtctatcatcaacaaaagnnaatattgtattttttcaggggtaatttaacataagaaggttaacatttnccattcaatttaaaactaaaaacangcccgggtgcggtggctcacgcctgtgatcccancctttgggaggccgaggtgggtggatcacgangtcaaggagattgagaccattctggctaacgcagtgaaaacccgtctntactaaaaaacaaat

SEQ ID NO: 1790 - DNA, 960 bp, Homo sapiens
  misc_feature (1)...(960): n = A,T,C or G
gagcaagaaccctttggaaaaccccngnnnnnttanaaangaaannnncnnnnnnnnaagnnagnnnnngagngtacaacgaanngagannnaccanntttttaaagaangccaaaacccgcaaacacnnangggggagcanncgaaaaaaaagcaacngaagcnnntaaaggngaccaccacccnnggacccgaancannanggacggcaccgggcgcaagcngnncacccacccctccggatggaangcccggaaaaaaganactnncaaaaangngacggccgccnaaagancctgngnangggcaaagcccgcaacccncgacngncaaaaaagaaacccccctgcgcancaaacgaaggaccnacagcccacnnngcgagacaccngccacagangcccagcnncccccccnggcccnacacnaaagaggaanccaccgccngganccccgagcccacanccggccntgcgccnnaactcngaanagccaanactggcacccaccanccacggcngacaatcgganannncnancnaaaaacggnaaaacaatccnnaaagcgaaccnggggaaaaccccaggngcngcacnngcgcngccccaagnangacnggcnnananccgccgggnaaaaccccacnggaacacacccacaaaaagggnaccggggaacccannnaaaccgggnnaacancggcgtccnngcccaaaccgngaaccccccccccnaaangnaanacancaggggnngcgannnaagcccncnccacaccgaaagcnccanccaccnagaccncanacccccggnccgccccncaccaaaaancacataggcgggcgcaggccgnantnnacgcgcaaacnaacgcnagnaccgggganncngaaaaacaaaccggggaccgancccncgggcgnnnaaancccccnnnncnagnagncgcnncccccnna

SEQ ID NO: 1791 - DNA, 743 bp, Homo sapiens
  misc_feature (1)...(743): n = A,T,C or G
ncngctngctgcctgcaggtcgactctnnangatccngggnnccgagctcgaattcgccctatagtgagtcgtattacaattcactggcccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgccccctgtagcggcgcattaagccgcggcgggtgtggtggttacgcccagcgtgaccgctacacttgccagcgccctagcgcccgctcctttcgctttcttccttcctttctcgccacgttcgccggctttccccgtcaagctctaaatcgggggctccctttagggttccgatttaatgctttacggcacctcgacccaaaaaacttgattagggtgatggttcacgtagtgggccatcgcctgatagacgggttttcgcctttgacgttggagtcccgttctttaataagtggactcttgttcaaactggaacaacactcaacctatctcggctatcttttgattataagggattttgccganttcggctatgggtnaaaaaagactgattaacaaaaattaacgcgaatttaacaaaaattaacgcttacaattctgagccgnatttctcctaccattggcggatttacccgaatgggcntctagacaattgttgn

SEQ ID NO: 1792 - DNA, 921 bp, Homo sapiens
  misc_feature (1)...(921): n = A,T,C or G
gncngaccctntgcaaacnactcngngctntttgcgggnggnanccccaacngaacccgccttnaagnggnggctnctnccaannnntaacccgggaanaanntttttttttnacangancgaanccaanggnnaannngngngaaagnntnantgggaaaagnannntaaaancaataacnntttaaatangnntgnaaaaaaaaantggggnggacaaattnttaaggncaaaantntgggcccaanaanttaancaaantggnaaattntcctggnggtnggggaantnncctcttanggaaatnncgcccaaggnttcctaacaaacggngccaagnnaaggggcgggcnggnaggctncatgggggacatggggggacntctggctcaagnctgnggacccgnaagggaagatnaggatgntggtcngggggcanntaattnnncnnnncggtttaatataattcaactnggngggaatacctaatgccaatggnaaaataagaactaattttttanaaaacttttacatgcttgggttaaaattcagaaagggaaaatagancaaagggaaatataaaatatttttcttnnaaaaacttaataaaaatgcgggntgacaaaanaancattttcatcttggcagnaanaaagttctcaagggacctaattatggggggggatactttttngaaaaagaaaaangctggaaaaatnaataaaangctangaatgtttctggcccattatgaaaagaangaaaataaaaggtnttcaaaaaataatgaaacanttttcccgtgcnnannnaaaaagnaaanttannaangaaaactcnnggccntntaaaaacaaanangggggggcggtataaacggtagatcccagaaaagganaaaagaaacncatgggaangan

SEQ ID NO: 1793 - DNA, 1127 bp, Homo sapiens
  misc_feature (1)...(1127): n = A,T,C or G
tanttcctttggaaacaatatgcaatgtgaagcggtcgcnctgtgagtttagtaaggctgtgtacactnncacctttgnnngcatgcatgtgcttgtgtgtgtgtgggggnnttttnttaggcatnannnacnnctcgccctccttgctctagtcctgggatgtggcatgcnagcagcggnnggcctnttttcagatcatggcatncaanagagcnnccanacatgtctnttnncatnntaanaaananaatcctnttntaactgcaatnnacttnaangtanctcagannttatnctctaactannccacntnaaatcatnnttcatgnacntntncnnattaaacaaaaaacantttgtaccnaattnncatcnncactnaancnnanncttcnnctanatctcatgncttaaantantattaatacnacntcnagtctatntgnacnaaactcntatncntccacctantnnnnctagattaannanntngctaatcacttantcantgacataatnttnttaanatatcnatgnctatnatanncatanaatnacaattgctcnnacannncncacatcannncactntanatatngatacgactnacacananntagtncatncgacntttacntcgttacctatcagancncnatatactacaccctacgaatcttnatntatntgnatatctattanaatatactnggangtcaagtactctcatgantcgagcttantacataatttctcataccanaaggtancatacatcnttttcaantacnccatatatttacatancncntacannacttataccncgtaagcatnaatattactgnntaccatatnncatatattantcgacgatcnngnncactncntcaatgnntctacatctnnctctcatctaannnanctcatnnanctcaacatncgatgntatnatnntatacnnananacctnttcntcntatngtnacngtcctnactattacttcttacannatanantattatatnnctactncatcangtatctcttnttcntaanatntantnantatnantanctanatcnnntagnnacactcgnttgcatctngntctgcantatcg

SEQ ID NO: 1794 - DNA, 791 bp, Homo sapiens
  misc_feature (1)...(791): n = A,T,C or G
agntacccgtagctcgagttngctntctgatnngtgggcncccnngcatgngcacatgnaanctagggaaagaatnnancttgagatcgtcaaagtgaggggaagaggggggtaagcaaaggagaaatgttatatggggttcggaggttttgtgtttgtaaatctggagtgatgggcatgttcaaatgcttctgggaaaggagctaataggagagaaacttagcccttcgaaaaacaggaagggatggatcctaggggagaggaggaaggattggctttagaggaaagatgtcctttacntgaggaaaaggaagaaaaggtgggtttagatctaaatctgtaggtttgctgttaggaaattaaggacttttcacctttatctctgaaatttctctggagttagcaaggcaaggtcatacacctgaataangagggatgaggcattgtnatatttgcanacatacaggtntgtnattnctttatgggaggaaaaggggagaagccactttttgtcaaaccggccctgtgggcttttgaaagccccttttggcctaccaantccattgaaggtgctcanaaggatganaaaagcttcaagggtaanaagcanttnttccaagcctgcgncnttnaaaaanaagtgcnaatacnanaaccagtgggaaaattgggnaaatttcccattcntttggaatcntctttagaaaagttaccttnaaaaaccttcccatnccctngaanangggactancaaaanttaaaattttanttangngggggaccncttttct

SEQ ID NO: 1795 - DNA, 715 bp, Homo sapiens
  misc_feature (1)...(715): n = A,T,C or G
tacaagctttnattctttttgcaggatcccatcgattcgaattcggcacgaggtgtcccaagtgtccggagcaggcggcagaggcctcagtgcggcaaacacagccccagagcctgtgtggcaccagcagcatcttagagccccaggtatatgctgagatcttatctcacgctgtcctccagtgtctggggggcccaaatgatggcacaggggcaggtgggctggaggggcgcagatgcctgtgttcanggagggtggccaccatgggccgaggtctcacccaagaccccttgctctgctcctcaaccttgcagtcacggcagcactatggtggactgccatggccgtgtgactttgggggcaagtgggagggcgccctgaataatgattgcaaggacaacangcaaaagctaccctanancangacacanggtgtggtacttgacaaccctantgtcacctcaaatccatgtcccacacttttgggcatgggtgggacttgtgaaccttaccttgtcaggcggacaatggcccaagaaccattgangacagttgtgtgccacttggaaaaanaaacttttttgnaaaaanccttaaattaaggtagaanaaagccaaaaaaatcttnttggnccgtaaaacccgggcttttnttaatttattcggccaacnttnttgnggattgaaccttttgattnaaaccccnggcnttgcn

SEQ ID NO: 1796 - DNA, 1429 bp, Homo sapiens
  misc_feature (1)...(1429): n = A,T,C or G
nnncgnnnnngcgccncanctnnncgnacnctnccngtccacnctagggggggnnggcnntatntgaaccccccccccctccccccccccctnnttaagnncntcgantcgnacgggttnttatcctncgnccccgggaggggtactanacccnggcccccccggncgttngnggncttgggcctcnagggnggngggggcatttgntaagatnaccancgntcacntctagntctaagnnnggnantnatacntntacancanctagcngtggncccagnatngnctcaagcaannncacnctggnanccgcaccnnccgcgcccgcgccnanantcnnnnaangactatattnntntnnctagccnccnttacnttntnnctcaacnnggaangnagncngatncgaacaccnnggnnctccaacnaaacnngnttccacgacaagtatatncgcgcngcgnangataggnngnaaagcntcnntngcgnnatnntcttccaggccccgnctggnangtntgtcngtgcccaaggacatgacntgggngacaggntcnntccggcatanancccccngattnnccccncacaacnggggggccngncangggggcanaggncncccaatgtaaangcncccnctccccaacgctntgggagaaanaaggttctgggtcacaantcctattntnngggacanaagngggggcaacncnggggcnnaactanncttggggcgcnaancganngtggggngccgcccaccanagngcgacnagggggggaancagntncgngngncccnanancatgcctncaaaggaccgcgtntnnggtcnntcgtngaannanccgtcgtgtncaanngcgtanggtantcacgttaccgtcgtactgctctncgatcnnngcaccgnanccntgcgccannaacgcacgntngncnccgcnangnngtgnnnncgatncntacncacgtnacnnnccgcgtacntnccncacgncacgacctcgttcngtgcgggaacgcatcncaggncaccactctcnccctcggcatcagctncacngntnncaaannaccgaccgntcacgccggctctntccacatnnatctnnaggctnntgtgacangtntnnnctgcntnccncacgtncgntatctancgcnngtacacccacnncnnactgcgagcgtcnnccntntntnncgnnngcnncgctnangtgtcgctcgctacnccatctncngntcncnnnnancggcatcttaancccntctcacagtgncttcnnnganacgcgnnccctagcgctgcncgccgngtncgatcgngtcctacngncgagactcntgcncggnngctncnnntgtaagtcatnaacacacnncnacgcnctgtgcntntgtnacgcnncnntnncg

SEQ ID NO: 1797 - DNA, 850 bp, Homo sapiens
  misc_feature (1)...(850): n = A,T,C or G
canctnnnntncannctggntaattgncncanactgtcantatganatnatcantgttgcnctnngggaannggtgggctgnttcatatggacnnccnntncattgnaacgnngannattntgaccagntcccncntnnnanttncttnntgganttgcncaantcaatttnnnctttcntgcgatncagacttccnccaattctattngaatgtnntgtataancntncntcnnntatnangaancnnnttnngncactnttcattnataaaacanntnnancatatnnttaatannacttatnatgnnatncntatagtttggtgntgtntnnggctnatcancctaggccntttnncanttntttntgnnngtagtgctcacanngnatnngntggaaantntcntnacgctntcnaaagancgctccgnnatngcgtccngnntcntccnnnttgntgannacntnctnnttntnncctaanannngccnannnanttagcnaatntgcctntatanngaagtggttatttcnttaantataaannttnntnancgangnttnnannggntangccnantnnnccntnatatnnctngnnnagnnngntnnaaacgnacancttnctcgancatcntngccctanngnanntgaanntcctaaagntggngnngaanannnntaaacacctgtntngnccgcnnttattcnnttcacccctatnanctannccnttctntcnatngnctctntnaantaaanncaaatanatatncnntcacncngtnntncnaaccntntagtanagcngtntnttatntgcntaaccnnatnnacatcacncng

SEQ ID NO: 1798 - DNA, 770 bp, Homo sapiens
  misc_feature (1)...(770): n = A,T,C or G
cccncnntntaantccgcncgaagnagaacangangcaccctacagggagctccagtttgaggnncgacaggcacttcggccaantccctgatggctttcgtccattacttcacaaaccgcttccacggctgctcctccacacgcaccgagccatgaggagctgcgcctctgagagcctcttcctgccctactacccgccanactcanaggccaggangccatgccctggggccacagggaggtgaggtgggctggatgccacacagatggtctccgtgctggctcactgaagagctgagcctgtggctggcctcagaatcaggctgggtgcagtggctcacacctgtaatcccagcattttgggaggctgantgagaggatcactttgagctcangagttcgagaccnncctggccnacatggcnacaccccatttctacaaaaaatttgtaaaattagccaggcatggtggcgcacnccctgtagtcccagctgcttgggaagctgangngggagaatcactttgagcccaggagttccaggctgcantgagccnggatcatgccactgcactccagcttgtccncanaaagacnactntnacccccctttccccccanaaaganatggcaacaagcttggncanccntgggngcttgaatgaaaccannanatgtttcgctttggattcccaacggcccttggcaccccctctacggaaaatnccancaaannaanaaattttttcccntttgcctnnaattgtgnn

SEQ ID NO: 1799 - DNA, 761 bp, Homo sapiens
  misc_feature (1)...(761): n = A,T,C or G
cccccntctattcgcccgaggcgaagcaggcttnttgctcatgtatccaagttgctgtcacagtgtaaatttgatctgttggaagaacttgtggccaaagaggtgctacatgcattgaaagaaaaggttacttcactacctgacaaccataaaaatgcccttgctgctaacatagatgaaattgtatttacatcaacaggagacatctccatttactatgatgagaaaggaaggaagtttgttaacatcctgatgtgcttttggtatctaaccagtgccaacatccccagtgaaactttaagaggagccagtgtattccaggttaagttggggaatcagaatgtggaaactaaacaacttcttagtgcangctatgagtttcagagggagttcaccacaangagtaaagcctgactggaccattgcacggattgaacactcaaaaactattangaataattttcttggaaaaatcancttatggactttaaccagttgcttgtgaaaaactaaggaagaaaaattttggggncatttgatccttcacttaatctaaagtctggggaattactttntatattatttttgaaacacttcttgccntatttttngccttnatacnnntcacaagcattttncacaaaattgntattcacccttntttttaaaagnnanntccaaaaattttaaaaaaataccatngcccccgnttggtnggngttcatattccaatnaacattttccatgnntcnntattanna

SEQ ID NO: 1800 - DNA, 758 bp, Homo sapiens
  misc_feature (1)...(758): n = A,T,C or G
nncntccattcgnacgagggcgnntgaatgtagtctcacnctccgagtagctgcnactacaggcgagngcctccatgcccagctaattttttgtatttttagtggagacggggtttcaccatgttggccaggatggtnttgatctcctgaccttgtgatctgtccaccgtggcttcccaaggtgctgggattgcaggtgtgagccacagcgcccggccaaaaaaaggaatnnttaagaggaaaaagaatgctaccaacctaaccacatttctatgactgnttatatttttccctgttccacatacntacatttttacatagnacgntcattgcagcatgagttacttttcactnaatannttttaaacattttccancngggtgtggtggntcatgcctgtaatcccnacncttggagaggccaantnaggcttattgggtgagtcangtgttnnagactagcctagcaacatggcgaaactgcancctctacnnaaaataccaaaaattanccangtgngctggtgcncacctgtattcnggcttctcaagaacnctnntgtgggaccnntttgtttgaacccnacgaggnangaaggtcgccctntnccccctctnctccccccnttncctncnccntnctnngttctccaccccntaccnttanctttaanntnanctcaanatnccatcctnanccaccanccctgtttacntccctcnattaanccgnnncnacactttccctgcctctntcn

SEQ ID NO: 1801 - DNA, 735 bp, Homo sapiens
  misc_feature (1)...(735): n = A,T,C or G
acctcgnnaattcggcccanaagacacatagtggatctgtatggcgtgtgacatgggcccatcctgaatttgggcaggttttggcttcctgttcttttgaccgaacagctgctgtatgggaagaaatagtaggagaatcaaatgataaactgcgaggacagagccactgggttaaaaggacaactctggtggatagcagaacatctgttactgatgtgaagtttgctcccaagcacatgggtcttatgttagcaacctgttccgcagatggtatagtaagaatctatgaggcaccanatgttatgaatctcagccagtggtctttgcagcatgagatctcatgtaagctaagctgtagttgtatttcttggaacccttcaagctctcgtgctcattccccatgatcgccgnaggaagtgatgacagtagccccaacgcaatggccaaggttcagatttttgaatatantgaaaacnccnggaaatatgccaaagctgaaacttttatgacagtcactgatcctgtcatgatattgcattccctccaaatttgggangancttttccatattnttancaatancgaccaaagatgtgagaaattttacattaaaaccctgtnaangnaaagaactgactttcctntgggtgggccaaccaaagtttgaaatncntatngtggctcantncgataattattaattcccaagncngggnaangagttnggannatnaa

SEQ ID NO: 1802 - DNA, 792 bp, Homo sapiens
  misc_feature (1)...(792): n = A,T,C or G
cacccatnnaancgcccgannnccaccattatttaacactccccttaactgtctttgaactttctcttttaacaaaaatgtcaagtctttacagttgtaatatcaccatgtttcccatttctgttaatacttctatgaacccctaaagtattgaagggaactagctgccagtttcaaggattacaagtttgagcctcctantnttcaacatcattctgaaccctgaaataatattcttctctgttaaacaattnctatctgtntgccacctctgttgntagaggtggttgttaattgaccttactaannnanctgcctttgatgannanttattgntattggntccngaataaaacattaaccttttnaantcagaaggaacctcggtacttcttaaggttngtttgcgntttctaaaaccananaataaggaactgatttggctatcangtttaaccattanaattttctgtaagctttncccacaaaaaaaaccattggtgatttgaggatatannnaatgnttttaancctttttaaaaataatnagnggggtnattctcntggncttgnctaacnaatngtncntggnaaaacactgncgattttnaanaaatttttttnaaaaanttgggcttnttcttaaananttaaaaaanngnccccanatttaaggncnntatttnnctggancctcnaaaatttnnttgtgnaaacgccccttnggttcccnacnntggaattntttaaaccattnttctccctttttgaatnttcanaattttntgnaaa

SEQ ID NO: 1803 - DNA, 770 bp, Homo sapiens
  misc_feature (1)...(770): n = A,T,C or G
accctnntnaancgcncannnntnaaactgnntctnnanttnncctcccnaattatggtnnnaaaacttaatganttnccaaggtnantgggaagcctggctttaacactcccaggctatattaatgagntcatgaggatgncatntnnntnatgcacttcaaagggtgttgtaagtattaactannttaatncaggtcanntgcatatattagcactcaatgcacggccattgatnaataaatgcnagnggtcctgatcactgagaatctaacctctgcttaaatacctttagtcataannagcttcactccctnantaacatgnttggatttcttgatcaaccatantttttacngaatttctttcnttactnanccntgaaatcngtctccttnaaantttctactttggtatggnctcttctgnntgctacnccaaatnaatntnatcctaatnctatntagcttannttccagcatanccacancaatnncattaaatgatttnttcatgtggcangactttaaactccgtcacccatcctatttgctcntctcaaagagcttccnccccganttgctccctgnggaaattgcccantttattaaatngnanaatgnttttttttnaatnctacagganctnccccgnttgntattggtgcaccantntctanaaannaggtnctcttgaanatttttctgganttntgntnttaccnaagtntccttngtggggcncttcccctttccctacgcctcttatnnn

SEQ ID NO: 1804 - DNA, 922 bp, Homo sapiens
  misc_feature (1)...(922): n = A,T,C or G
gcngnnnnnnagnnnnnnntgnnnncgctnantgaattntncaatgggnaactcttgcatgatatngnaccannggngnaaggnnccgttgctaggnggtacacaggatgnnggccctanccaatncatcaantgtatgacgacnattncgggagggacacntntantgnaccgcagnngcccccactatcaagncggttnctatggttacanacnntgtgttccattttgtcntnaaagncnanaattancatccngttcgcaattgaagaaaancccccattgaaccccnattaaaaaattgcncccgcnttnattnccccgnaccttaaaccggtcaatttaanngggnaannatggcccccancttttngggcntttttaacnttnttcccggtttccatttcncnaaangggtaanatttaaanaatggaaaatttttttnttgaaaagccanttttttntttaccaaaaattaanaacaannggtttgcccaaagctttaaacnggntggtcgcnattttttttatttttcccanttcctggcattcccatnggcctngganaatngttttccctcccntgaaagggcnttaatttgccttggggaaaaaccaaaaantcgtcccntttttttttctggaaaccccncaaaancccttancnnccnaaccttttttttttttnttttccctttaanttnncatccttaaantaaactgnttccntnggnggaaaaaaccattcntggccaaattnggaancttncccaaaacntggtccccctcntttttgtgcacttaaagccataaccgggggaccaaacanaanngggtgctttaaagggcnaaggnggcctttccaaatgggaaatcccnaattattttcntttaaccaagaaattggggcaccggggatnn

SEQ ID NO: 1805 - DNA, 922 bp, Homo sapiens
  misc_feature (1)...(922): n = A,T,C or G
accggangnccgnnnnaccnnnaanannanccnnaanacnnanacgancgngaggnccgaagnagganannacaangcncgggngagnnnncnngngnnangcnaanncannccncccggcngtagngaaaccccttnggcaacncgcgcnnnangcaaggaanccaacgaancccncacggcgacgagaannggaagcnaccaaaccagganganagtnttcagaccnangcaaaggaagcnggangggangaagaagcngaacaacnaggaaacccagnaacaggaggacaagcngnggnagaaaangangcccccngggngaagccnacggaaangccgaganctcaaccaaanagggagaagcngnnggnaaggnccccgggcaaaanacgggngagaaaangacngcanggggannaccnngnaaaaacggaaaacatcaaaacggcacnngacnaagnaanggncgaaaaaagaaggagnnnnccgganaccanagagaggaaacgaccaggtcaaactaactntggcacntgngggaccggganntntnnacaaaagccacaccactcgcancaacngggacacacangatggncgcagangnacccctagnggnagagaanaaaacgnggananngggacacttaaaaaccacangggcaaccaagaacgaggangaangaaggancctagggcattccaaaaagcaagaaaaanaaacctaagcccctnggnaaaccgggacnaangaagnccngcnaaaaaccggaagacntngtngagggcaccnaaaannggggacccccnnaaaganccgaaagggagnaaannaggggactccgggaaaaaaacaccccaaangacacacncnnaaaacncncgggcaaacnnggggaaaaaannnnaanaannnccn

SEQ ID NO: 1806 - DNA, 788 bp, Homo sapiens
  misc_feature (1)...(788): n = A,T,C or G
ttancctttnnannnccnnnnnnttttgcangatnnnntnnnattcaattcnnnacgaggagtcaggaaggtaaggcggggnttgactgaataaactctgccttttaaattgntcatctgggccgggcatggtggctcacgcctgtaatcccagcactctgggaggtcgaggtgggtgggtcacctgaggttgggagttcgagaccagcccgaccaacatggtgaaaccccgtctctactaaaaatacagaaaattagctgggcatggtggtgtgtgcctgtaattccagctactcgggaggctgaggcaggaagaatcacttgaacccaggaggcggaggttgcagtgtgccaagatcataccactgcactccaccctggtgacagaggagaccccgtctcaaaaattgattgatcaattcagcatctgagggctgcaagtacagaaggaatctattctcagcagggcatagggcacgcactggcttaacagtttaatatataaggctcaaatagtctatacctgaactgctataagcaagggcgatagggaagtggatagattgcttcaancaaaagtgaactgtgagatctncaagacagagggagaaagatctgatccaaatgagaacagattggntattgcaggtttcacagcctaaaaaaantatctttttgccaaaagaaatattaaatgattaacagtcctccacgtgtgttaatgttcaaactntattcataatgngtataaatgggtaacaaaaatgnnntacaataaatcttttgnn

SEQ ID NO: 1807 - DNA, 968 bp, Homo sapiens
  misc_feature (1)...(968): n = A,T,C or G
ctcnnagccttgcaactcnngtctttttgcaggatcccatcgantcncantcngcacgangaccacngnaaggtncctgggcctttttngggggataactgggnngggcnaancnacnananatttgncnttnaaggnctncttcancagggancttanctggttctnaaatccngataccnagagaanntatccntnctatggnggatgggtttggaaaccaggtcagaaaaaaggttttggtntaccttggctttcaaaccgggaattgaacaagccgaagaaagtnaaaaggggttgccccaaatttagcctnggaatccagtggggcntgaaaatgttctttctttaatcaatccattgggtggaagaatggtccccctnntngantgnaccccatttattcaaaattttggggctttcaaagaaaatttttnggtggggggttagnccaaattaaaatccttaaaaccccttccttngccaagcccccaattggggntcaaggttttgggggtnaccccaagggccntaaccattnggggngggccnaaangggaatttcctngccttangtcccccaccggaataaaccaattcctttttaacccaaatgggcttcaagccttcnttttngggccttccggatttgggttaattttcccacccaaaaaaggaatggaatncaccaccgtttggaaagttttttaatantggaatggaccaaccccagccgttggttggangcccttggaaatgggtaccaatttcctatttatttccccaatgggnggcctggataaaanngggggcctggaaaagggaaatccgggnacttggggtggggtccntgccaaaaatcccccaaccttttggatgtgccgtggaaaattgtaaaataaccatcaggccgtttgaatgggatngggagaaanaaaccttngccaatgctttcaagttaccaanaa

SEQ ID NO: 1808 - DNA, 733 bp, Homo sapiens
  misc_feature (1)...(733): n = A,T,C or G
ccccgatnnctttggagaatttggtccttnaccttgaggaacacttcttcttcaactttttatttctccctgatgttacagtttggtagatttcaaactggaatagctagcatgtgcttgctaaataattttatgccagccttatcctgtatcctagctgttcttaacagcaggtacaaaaatgcctgtttttcagcaaggttgaaattgggaatgtccttttgaatcagaagaaaataggccatagactcatctcccagcacaaatgggcattctatgaaatggtactggccctaggaggatttcctcaaccactctcctactcttggccttgaacctacctctgggttggatcttactattgtagctgctcactataccctcctgcatgcttagaataatgctttgaggggagcactggtaaaacacagtatttatttttttacctcctttaagaggacttggaggtaagttgcattcattcactcaagtttccctcttgctgtctaatanaagcttactttttgctatatcagcatttgttacagccaatatttaaggacaaaatttagaaaatatatcatttcctggcccatcatcanaactaatacagcttaaccttgcaagctaccaacttttgnggcaagctananatctttaatttgatatctaaggngcaaggaccaacnatntatttaagaaaattgggagacatgnaaggcaaagcttttgn

SEQ ID NO: 1809 - DNA, 744 bp, Homo sapiens
  misc_feature (1)...(744): n = A,T,C or G
accnnccaatcgccgaagnttccnctgacaccaggntngangcatnggngcnatttcggctnacngaaagctnagcntaccngnttcacgncnttcnnctgtcngancctnntgagtnnctgngantacangccttngcnnaactaaantttngnattgtttntaanaganatggggtttnnccnntatagccaggatggtcgcgatattcntgaccntcctgaagcgcctggctgancntgcnaacgtgtgggattatagggtgnagagccactgcgcctggataanctattancanttttcngagacngcctggtggngtcaaccntgctggattgcactgnngtgatcttggcatcactggaacctcacgactcctgggtggcnaacgattctcctgtntcaacntncccaagtngcttgnnccnannggngnccaccnctataccccggtaatttntgtatttttactgacatacncgggtcanactgatantgtccnngngtgntgatacaantcctganctcnagatncanctganntganctntcnaaagtgntntgaataannagtnngntccannagccncctgcccanntattttaanaacgtaccattaataatngnctatnntcancctggcnttgntcanannanaacnttnccttattcnccctttctantagacngccntnanancnntttttntnttnngnggcccccaataaccnttncccncntcn

SEQ ID NO: 1810 - DNA, 794 bp, Homo sapiens
  misc_feature (1)...(794): n = A,T,C or G
canccntcntnnttgctnaagtnccagnctngggacgggaattggttttgatcttgnncaaaatcttcnntanggttgctnttgctgcntgactgctgnctacattcggaaaantctattttgtgaattggnagctaaatcccttactaccctgacaccgtggnntctactgtatttcttttcaaggtgcnatttgcttcagagttccagncagntagattaagcaagaggctccagaanaaatgtttacttgaattttgcgcttcctttcttgatagtttcctatataaaatttgtcattgaacaagagcaaatgctgaagtattaatgaggcacaaatgactgtgccccattagcaagaattcaggaatcaatacagacagtattaaattaatagcttaagtgaanaaaaaaaaaacctagtgaaaatgtattagccccnattaaatggccnaaaggacttntaaaaggcnaggggccttaactttccagtcctgcaccaaataaaaaattcctnacgactctccacttttnccaagtgggaggtttggtcttaactggaccttgtcgtatttttnttnnttngaaaggncggaattngctggtaaaaacttttncctaccnttggaaatattngngacnccctaggcnnttttttaaggntctcnaaaanaggggaatggccttattgcccancttgttnacaaagtngtgnnaanaaaaagccccccctgngctgtcangaaaaggggnncntctnanancctctngggtttttccttttcnncnggccg

SEQ ID NO: 1811 - DNA, 739 bp, Homo sapiens
  misc_feature (1)...(739): n = A,T,C or G
tacccccgnntcgaattcggcacgaggagaaccttgacaagaaagatgcatcaatcaacatagaaaatatgcagtttatacacaatggcacctatatctgtgatgtcaaaaaccctcctgacatcgttgtccagcctggacacattaggctctatgtcgtagaaaaagagaatttgcctgtgtttccagtttgggtagtggtgggcatagttactgctgtggtcctaggtctcactctgctcatcagcatgattctggctgtcctctatagaaggaaaaactctaaacgggattacactggctgcagtacatcagagagtttgtcaccagttaagcaggctcctcggaagtccccctccgacactgagggtcttgtaaagagtctgccttctggatctcaccagggcccagtcatatatgcacagttagaccactccggcggacatcacagtgacaagattaacaagtcagagtctgtggtgtatgcggatatccnaaagaattaanagaatacctagaacatatcctcagcaagaaacaaaacccaactggactcntcgtgcngaaaatgtagcccattaccacatgtagccttggagacccaggcaaggaccaagtacacgtgtactcacagagggagagaaagatgtgtcccaaangatatntataaatatttctatttanccattcntganatnaaggagccctgnttgcnttgatgnaaaacantgntatnatc

SEQ ID NO: 1812 - DNA, 922 bp, Homo sapiens
  misc_feature (1)...(922): n = A,T,C or G
acctngtntcgctcaagnatgtnggtncnnnntctgtnggaagtgagntntnctgnggcgtcggtnnttcgtgatancttgcntcngttgctcgatggtctnngcttanggtcttgnnncttntacccttgnnnnnacccgnccnnggcgnnnatatnnnntngntncgagggtnctntnttganaaanannacgtgtgcngggctntctanctggggngnnnngcnntcgtgncttatatntggnaggtcgtcnncntntgngtcttccaaaaantctntnttgnactnttctacacanaacagantnnnatcatnggctagatggatncngncanagccngnnncnnnatngnngntatttctganggtctgntntnaatatcacntccnngggagncacnggancatggntctggntaaaacnnntcatanccccncaatatgnncccctccctntncanccactttttcttntgcnatttttgcccnntttccccccctcancttcnacgnaacaatgnacntaggggnccctnttggnatgatnngggncttngacaaagnaagggganggggcctcngaaacgngattatcangcnccccccctnatcgcttggattgtcaaaatcattggtgtaccctcaaactgggngnngnngaaatcnttanctttttggcccccnccgtgnngttttcancccccaanananacccacntnncgccncctttgttntaactnccnaaatattntgntccccccnngcccttnggggatttcgcctcnngataaaaaanaanccntctttnttntttttccggacccaaaacccttttgtaaatttnnttttcttaggcaaaagncntatttnccccncttnntttcacctttctttgcccccttntnnaggaannanaaaa

SEQ ID NO: 1813 - DNA, 1188 bp, Homo sapiens
  misc_feature (1)...(1188): n = A,T,C or G
cgacancnctttggnanctcccngtctttttgcnggatccctcgattcgaatncggcacgggagattngancgccacctggggcantttttncctngcccctggngggggtcnatctanncgnatgcntgngtangccctcntgctcccnttntcacccgtgnggaggaaatcacccagccanncgagggatggtccagaacccnntaggcccccatatcctgggaaanccatactcgtnccatggcnaatgggntnggnaaaattcctggaaaggnnggtggtaaaaatttcccccggggccntattttcctntacccacccgaaangggaggggaaaattttttcgggacccagggggnttggggggggcccattnannnncctttttcctccacccatttagccggaatnaatncccccattccnggggnttggaaaanaanaaantnnnnnncgctcccaagnaaatgggaaaaaancctnggggcccccnaggnaattttnaatttttnaggggggggaaaaaggggcccattaatnnatttgcaaacccccttcaagaaaanaanttnggcccananaaagnnaaaaaatgggtcccccccttgggtnaaaaattggaaaggaatttttaccccaaccctngggatggncctttccctaagggaaaaanaaatggtttcccccacccnnggcggngggnaattccctgagggggcctttttggggccccaaggggtnaaaanttttncccccgcccnccccntttgnacttntatnccaantttccaaaancccctnggccaaaanaaagncaagggacccccnccttgggggngaaaggggaaaggnaaaagaacctggggaaaaatgggaaggnaacatncctngggggggnaatnananggngggtctcgggggggtttcccaccnaaaggnangggtcggctttttgggcccccgctatttaaggnanaaaatacctgggnggaggccccgggggccnctgggggggggcctntnccaattggtgggcaacccccccaggcnccctntgggggacnggcntggganggggggggggggggaatcccnccccggaagggcccggggagggtnccttaggaacccnggcccggggccccaaccntngggggggaaaacccnccntcntcttacntaaann

SEQ ID NO: 1814 - DNA, 763 bp, Homo sapiens
  misc_feature (1)...(763): n = A,T,C or G
ntnagtcnnnncgaggaaggatntcactctttgccctgtggcctctcccttttccccccttctggttggaggagggagaagtgggaantagcttggnanctggnttgagcacatnaggccaangctgcagggagctgtggtcgcaccactgcactctagcctgggtgacagagcaagaccccatatcaaaaaaaaacggccgggcgtggtggctcacgcctgtcatcccagcactttgggaggctgaggcgggtggatcacaaggtcaggagatcgagaccatcctggctaacatgatgaaaccccgtctctactaaaagtacaaaaaaaattanctgggtgtggtggcgggcgcctgtagtcccagctactcaggaggctgaggcacgagaatggcgtgaacgcgggaggcggacttgcantgaanccaagatcgtgccactgcactccagcctgggcgacagagcaagaccccattatcaaaacaaacaaaactgtgatgataaaaaagccccataaacactaatatcaacccatgctacttctgccttaaatttttnaanattctttgcacgttgnttactttantaacnctgggnnaatcnctttncccccntgggngnttgnagnnaaataaactggttatccctngcctntgaaaaggtanaaattaaagtcaattttggncnaaaccaactctantncacttnnctccncncnnccctnnncccncaaanatttctcnncntttcttttccccncn

SEQ ID NO: 1815 - DNA, 947 bp, Homo sapiens
  misc_feature (1)...(947): n = A,T,C or G
ctctatcctttcactccngtcttttgcaggatccctcgattcnaatcgcccggggggccntncnncnngaccccccngantgngngggggggcttttggggccgggagaccccttngttttnncttncgtgcccggagttgggggcctttanggggcncgggaaatantnngttttttancaaggganccttggttcccnctacccttnccggtgggtgggaggaggganaaatttngccccttggggcttgggatgggnnaatctctccccatgggaaanaaaccccnttncttngtaaaaacccgttttgggggaaatncgnncccnccttttccttaaagaaaagggnaaanaatttnccnttttaatcccccnnncaatattttggaaaaatcctnggggccntttttnggaaattaaaanttaaaaaagggccnncctcctgggccctttaanccagggaagaaaatngggcccccnaaanccctgggnccattggganccaaagccanttgggttttggggaaaaggtttccaaggaaaagcccaanttcccnggtggttaanccatggtncaccnttngtngcccttttaaaaaaattaaggccctggtantccncccatttttatttaccngggttantaaatttttngggaggttttantttttttcaaaaatccatggttnccttggncccccagaagttccttttaagggttnaaccacctaaggggacctggcggtcccatggtacctaagtattaancagcctttggggttttggttaanaaatttngggcccaccatttttggaattattaaatggacccaccttccatttttcnccatggttacctcnagttccccttaaatanggaanggggcctctttttggttgnanccnggnanttggattttttttttttttaacntttatttggat

SEQ ID NO: 1816 - DNA, 760 bp, Homo sapiens
  misc_feature (1)...(760): n = A,T,C or G
nttattcgntctcagcttgcatgcctgcnggtcgantctcatngatncncaggggtgagcnaccacaccaggccnagcnttttctttcaaatacaaggaaatntttttctgatttaaaaaaaaaaaacgaactttttttctgatnatcaaagggaaagttgcaaagatgaaaataaangtcatctgtaatctcaggtaataccaggtaattaacattttgctgtatttcttaccactgaaaaaaatgcatagttttaagctgggtgtggtggtgagcatgtagtcccagttaagtgcccaaagggttcactttaccggctgctagacagagtcgatttaccaagacaggggaattgcaatggacaaagagtaattcacgcagagcccngctatgtgggaaaccagagttttattattacccaaatcagtctccctgagcatttggggatcagagttttcaaaagataattttgcgggtaggggcttgggaagtggggagtgctgattggtcaggttggagatggactcacagggggcggaagtgaatttttcttgctctcttctgttcctgggtgggatggcagaactggttgagccagattgccgtctgggtggtgtcagctgatccatcgagtgcagggtctgcacaatagctctgatccgtagggncanaaaatggngcatattattcccaagaaccaattagggatngantatactntntgnagccttatcttcttccccctaacngnanttccac

SEQ ID NO: 1817 - DNA, 940 bp, Homo sapiens
  misc_feature (1)...(940): n = A,T,C or G
nncngannnnnganncnncttacnnttgnatnacccannnctnaanctnnnttnnatntatngaatnacggtngnnnangcgncttanntngantnaanntttctttnnncnnnnnngattttaaaccccttnngnctgnccncctnanaanntgccatgtactaactccgcttgctgatgactgaagtggcctggactaaagatgagnttaaaaagaagctctggatgatgtaacccttcctcggccttaaggccttcatacctcagctcctgtcacggctgcacattggaagcccttctcccatgggaaacataacaaagcaggctgcattaggaattatgcagatggttgaaggacaccctcattgaacatgctcataccaaacctctccttcaagtcagctggttcggtatagagaagttcagctccctgacagagggatggtttngtttatcagcagagaaaatgaagntcacaataacttgtggnatccgagatatactaccaaacaagacatgcaaaagcacctnngaagaatatgtttcttggagctcttctgtcaanattatctcgnaaccttgcttnaanancctgngcaccaagggangcangatgggggctatatacggacttnnancnggggcccncgntcgannctaaatgggcataacccgggccttgggnggattcatccaatccanntcggaaaaaaggccaccctnanctaccttnnnaaaggnaannngtggntaagcnccccccnnaaactatnncatggggnaaanncccccnnnnanggnaccatnaatanaatgaanggcccttccacnaaaaanaaatttcanggcnntaangcanctttcntggatncttccccccccccccnactgnnnntntttcntcccccccccnggctaaaantattgggggacccccct

SEQ ID NO: 1818 - DNA, 957 bp, Homo sapiens
  misc_feature (1)...(957): n = A,T,C or G
tgncacnnngnnaagtgtgtgnaggcctgnantttngcatagcgtanntttgtgttgncnnanantcnctaganctatatancngntttggnctntgnaccatagagtgcncncnngctnaggnngngttnactccgagtgagaatggantggtttaggcngtttntttanctggggcnagaggcncgtgtnattttgncataagntcangtcncntanggcnccatgctncccngagncanngggtaactannncnctaannatccnngttatttcgnnngatananatcctnntggngatatggnccantntatgtacctnattgtncntnaantaattntnntntggttngtgacctatnntcnccnnatttattacncggngntagttcanncctganngngnngacnatnnngtnntcggctatttanaaccgntnctatattgggntctgtgnnncctacnannattgntacaacctactnttnttntttcntatcttcactaattgntnatgcncnactggttngaaagatcgnccanncnanttanatggtcntnanaantnaatggagagnacnantttgnctnnggcaanaannnngatnaangngnnccaaagtgnntcnngngnggnggcgtnncannnaataaanagggcgnggggnngaataatagnnntncanncttatggtatgaaannaacnnctgggnngtgngnnttaancnccaanngncnattnttntannnngngngntgctctnanngttgnctnnatagagtcccngctntntttnatanngccgcaaatancnaaangagtgttntnttcnannnanaaanaatactgncncnctatttnctntgngcattanncantcctnatncgnnnntntaaantcncnttnnnttatntnnngttcacanancatattnccgtantntgtatatnac

SEQ ID NO: 1819 - DNA, 972 bp, Homo sapiens
  misc_feature (1)...(972): n = A,T,C or G
tnnantnncttcaactcttgttctttttgcaggaccctcgattcganacaagcgacactctagtggtgatgggaatagtaaattaaaaagngagtatcntggatttggacaacgnnnancnncaaaatntgagatggttgaatgaatggcccnntgtcatgatanatnaggncacttttggaaagggttgnggnncgaangngaaatattttcnngtggnttnngagctatttttcctttcaagtccctctcttttnncnttgcnatncccnnncttgtnntggatgnattgnancancatctcctnntnncctnanantnggaaatngttaaatnncntannggttcnccattcatttnnttaccaaacggntanccnttntttccnctncccttttnnccctcgntnannnnttctggttttttttcccccccctngggctnnanatantnggtnntnccatnntttcntanngggggaaaaccaaaatatctncccccatttttnnggntaacngggntaaaatctgntngctcggnantttncaataaaantttantctcccnccnactcncaatcgtnntatgtaaaccccccccnttttttttcncctncngngaaaatatatgggcntaaaanatnatnnatntaaaantttnttttcaccntnngncancttnganttntcncactnataatntctccnntncctnagangctncactttcnantttccnantnnctttcntattanctnnccanccnanncttaatattgnccattcgnncaacntgggcnccatttcctttttgngttantncanaaaattanccctttcnttgtnagcccccttttntnntntttnatntccctttngnctctttaacntnggtgancnaaanantattataccntcccaanaacnttntctttnncccctaaatttccctcttttaaanaccctttggtc

SEQ ID NO: 1820 - DNA, 724 bp, Homo sapiens
  misc_feature (1)...(724): n = A,T,C or G
agttacacgttcnttaanacngtgcactctgaantgtactcagtgaaaatctgttttgngtttcattaatgctatttcaccagttagacataattacttctaccgntgtgaatganacngatgccggnggagctaccanatctttcncactcaactgctaggtcaattagattgccatnttaaaacttggcggattctacaagannatntgacnaccaggaactacatnctatgatggaaaactatccatactgnanactccntgtgtaattatcatgctgctgctgctgtgctctggaantctcaatatgacatttanactctgcgcctactaaaggcatcttctggagtttttgggaggananaaactgganaattaaatcgnattttngccanaagactcttacttgcatgtgtctcaaggnctncaatttttctataagnnnccatatccaangttcanaattcatgtganatacttctttggggcanaagnncttcattcctggnntntattggatcgnaaatctgtagcaagangctgnttaaaattaccatantggtttnntatcttatactcagctctcnggctattgaacttcttttctngtttgaagntagcttcaaaatttgctcctatgctnaattacctgnaaatattctggatangaactacttcgaaatantaatttggtnaaagatatgacaaaatgaaatgccttaa

SEQ ID NO: 1821 - DNA, 1507 bp, Homo sapiens
  misc_feature (1)...(1507): n = A,T,C or G
gngnnnnnnnnnnnnnnnnnnnngngnnnnnnnaggggngnnnnnnnnnnnnnnnnnnnngnngngnggnnnnnnnnnnnnggnnnnnnnnnnnnnnnnnnnnnaggnnngnnacttttttgggaaaaanccccccnnnnnnntttttaattnannancnnngggggggcnccccgaatgngagggnnngnnnncnagataaggggcggnnnnnggggngttttttttttcnnannnnnnnnnnacnnnncanggngggggggggggggntttttngnangnncntnnnnccnantnnntctangngngnngcngcgtngngngnnggggagangnggngtgngcnngcgggngggtgaagcnaatngagggnnnatcgggtgngacnnggnngggaggcgggaatggnngnnggngngagtnggnntatgtgnngnngcgtnccgngnnnggggnncnnncgnggggggngngcngtacnngggngcgaggngtancgnggngcngcngtgngngnnctgggnnnagnnncgnaggtcgcnagggggagcgggcgggngggggcnnggngaatgtcggcggnnnnnggnnggngnccgnnagccgcgnggngntngctgnggcagggnantggngnngngtngntntagagnacgnnngngnagcacgtgcggcgtntagnngnaggnganangggcgatntggngactggngnggagggggggacntntnggngangtgtggngnanggacgnngntgcgngngcggntcnggggngactgaggggnntgcngatgnnagggngnngaanggggtcnngnggngngggtgngnangnntnnggngnnngnncngancgntnncnggggnngngggngtngtgngnngnnnngcgnagngnncnngngnnnntagnngngggnnnnngagagnnngggnnnnnatcgacngnngnnggtacnnggtgnnggtagncgananngatngggggnangngcgnntngnctngtncgnngngngttngngnaagacgtnngcgnnannctnggggngngganngagtnngggtgcggacngngaangggtangggggtacgnnnngtangngggnnagcgnagtngtagngcgngtggtgcgnncnggancnnnggnnacnnnggtgngatgggggcacgngaagacgagcgctngcgcacgnnggganganatagntgnggtaaganagagggnngcggnngnatgctgtcgacgtntncangtngncggtgngcgngctgtngcntgnagganggggggggggnnatgtgnatgngtnnnagcncanggngaggggcnnnattagcgtgnggcgcgggctnncgggggggncgnnngtcatngacgncnngtngcggagtnttgcgncngngcgagagnngnnngnggngggngtnggcgcgggtatgngnnaggagatgagtgcgngatgggagctcgctctnngtaggtnggggtcgatgcgccgn

SEQ ID NO: 1822 - DNA, 726 bp, Homo sapiens
  misc_feature (1)...(726): n = A,T,C or G
ntttgaccccttatcgccgagtgaggaaagaatagtcagtaaattgatgcgatccctaaaaagggcagcattgcagcgcccaggcataagacgtgtgattgaagatccggaagataaagaaagtagactaatcatgttggatccctataaaatatttactcatgattcctttgagaaagcagaactcagngttttagagcagcttaatgtcagtccacagatctctaaatacaatttggaactaacatatgaacactttaagtcagaagaaatcttgagagctgtgcttcctgaaggtcaagatgtaacttcagggtttagcaggattggacatattgcacacctaaaccttcgagatcatcagctgcctttcaaacatttaattggccaggttatgattgacaaaaatccaggaatcacctcagcagtaaataaaataaataatattgacaatatgtaccgaaatttccaaatggaagtgctatctggagagcagaacatgatgacaaaggttcgagaaaacaactacacctatgaatttgatttttcaaaagtctattggaatcctcgtctgtctacagaacacagcccgtatcacagaacttctcaaacctgggggatgtcctatttgatgtttttgctggggttgggccctttgccattccagtagcaaagaaaaactgcactgtatttgccaatgatctcaatcctgatctcataaatggg

SEQ ID NO: 1823 - DNA, 746 bp, Homo sapiens
  misc_feature (1)...(746): n = A,T,C or G
ngttacaccttnnantccgcacgaggagagtgctnccttaaaaatgcaaagttgaagaactgtaacctcagaggagcaactctggcaggaactgatttagaagaatngtgatctgtctgggtgtgatcttcaagaaanccaacctgagagggtccaacgtggaagggagctatatttgaagagatgctgacaccactgcacatgtcacaaagtgtcagatgagaattttaggggctggaggaagatgtaaaagatgaaaatgttttccttatcacttttctttctccacccactcagttgtctagaagaaataacactgtaaggaaatttaaaaaaaaacatttagaggattatgcttgttttgagtggtgcataagggaaaaaactgactttttttccatattctgatttttaacagaaaagcactcatttaatagatgtagggaaactagatattgctgccttttgaatggggtaggggggtttacctggttttatgaccaggcatagtatctattatatttgcttttaaataggcatgatgtggaaataccatcttggtttgagatgcattttgagggattttaatttatgggaaagcccaacattatgccattatatttattggnattcctaanatgcngtatgggatatttaaaattgntaaaactttatgaaaacttgggaaaangntgttcaaggtttataaataacctttaatggatgccctcccctcttttaaannt

SEQ ID NO: 1824 - DNA, 1059 bp, Homo sapiens
  misc_feature (1)...(1059): n = A,T,C or G
nnnnnnnnngnnggnnnngggnnggngnnnnnnnnngngnggnnnnnnnnnnnnnnnnnnnnnnnngtnntgantcttggaaancccngnnnttttngnagnacccggggggccggattggggttgcggnnnnnagggggcnnnanctttttttttnnctngnggcccggngncgggggggggggggttnnannngggngnngccnccnntgntnnnnnngggnncgcnnnngngncngggcanngggtgagggggggtnngntgggncnnggngggntngncggtnnngncgcnaccngatggtggggntggtnggnnntgccngggggaacgtgggnnncggcgggnnngtgggnnaccgcggggngggggggcggnctnccaaanggnntgcggggggggncnntccgtgggggnggaggnctggncccnggggggaggngggnccgnngggncccgncngggccctgtnnncgcnccnggncggccnagcnggggccgnntgggggccnngngtgcnnnnngcccgggncnnngntgtcccccggcnagggangnggnnctgggncggggnggnctgtgntggggtgcngggggncnggggggaacgtgggggggggggggncccatggggggggggnnnnngtcnggnccgaggagggggnggcncnngggnngnntanggnanggggcngacngangggncnggnnnnggnggngaagncncgnngnggnngnngtngggcgggtntngcccnatcagattgngngaagggggnggngnangcgnngcngngggggggggggaccggggnggncnnggggngtgtgggntnnggnnnncggngcgtnngggggngnaanggggncggggnngcagggccgggtgcccggtgggngggggtgnnggtggntggccgnnngccggggnggctncngggcgngangggggtnangnccnnnngggngggggggncancggagggggcntttangagccggatgnnngnggggnnggnggncggggccnnnacaattgggangnnnnggngtgancn

SEQ ID NO: 1825 - DNA, 739 bp, Homo sapiens
  misc_feature (1)...(739): n = A,T,C or G
nnttacncgntcgantcgcacgantggangaancnacaaggaaaancnngcncntgnaaaangtncaggntcnaatncggatggtcctcncctatntgttngctnagttgagcctntggtntcggggtgtccacggggggctcntcgtgctgggatccgccaacgtggatgagaagtctcctgggctacctgaccaagtacgactgctccagtgcggacatcaaccccataggcgggatcagcaagacggacctcagggccttcgtccagttctgcatccagcgcttccagcttcctgccctgcagagcatcctgttggcgccggccaccgcagagctggagcccttggctgatggacaggtgtcccagaccgacgaggaagatatggggatgacatatgcggagctctcggtctatgggaaactcaggaaggtggccaagatggggccctacagcatgttctgcaaactcctcggcatgtggagacacatctgcaccccgagacaggtcgctgacaaagtgaagcggtttttctccaagtactccatgaacagacacaagatgaccacgctcacacccgcgtaccacgccgagaactacagcccttgaggacaacaggtttgatcttgcgaccatttcttgtacaacacaaactggccttggcaagttttcggtgcataanaaaatcaggtgctacagcttcgagcctnttaaaactatagtgagtcgtattacctaa

SEQ ID NO: 1826 - DNA, 1373 bp, Homo sapiens
  misc_feature (1)...(1373): n = A,T,C or G
annnnnnnnnnnnnnnnnnnnnnnnnnnnngnnnnnnnnnnnnnggggnnngnnnnnnnnnnnnnnnnnnnnnnnnnnngnnnnnnnnnnnnnnnnncncggggggnnnnnnnnnnnnnnnnnnnannnnaggagnntngaaactnctttggggaaaaaanccccccnnnnnnnnntnttnnannngnanccnncnnnggggggngcgccnncctttgnggggggggnnnnnngnnnnnnangggggggggggngngnnnnaaanancttttttttttnnnnnnnnnannnnnangnagcnnnnaggnggggggggggntntttnnagagnnannnngtntnnngnnttttttancnnaggagngcagggggannnnnnnggacnnangngggggnnagnaaggggngannagnnannngggangnnngaggnatcnngnaagannnanncgnnngngggnannngngngcgggnagngngagagnnnagcncnngagggngggganggngnngangtgtnanganngngngnaggggagancagnngggggngaaaangnggngnnannnnnnggaanggnngnaanangagnggnnagngtngcgggcnganggcannangnngcngnnnagngngnncggngnnnnanngacagngggtangnggnnnnanggnnancagaagnnntagnagtgatanagngaggcgaangncananggcgnggnngannggngngnaangnngcgnganngnnnnangcaganggnntnagngngnnanggcngnngggngnagngaannangagnnnngnnnngnnggnagnnnnnnnnnaagnnnnngcnagntnnnngnngngcgnnagcgnnaagnntgnganggtggnaanngnacgtnnangngnncgggngngngnaangnanngcngtgngngnggnagngnnnagnantggngngtgcnaggnngnngnagganngnnnnnannnnanngnnacggagcnncanggnngngnannganagangggngnaancangncncgngnanagcangnaggcnnngnnanntcgnnantntnnagagnatatcannngnannnatgtnnganagngaggacngngngagaannnncgngnacgnnagcgangngnngntangaccangnangtnnnngcacngnnnntatgcgganngncggnataagcngaccgnatnagngggacnnnananagatnnggnagngggngcgctnnngngannanatcnntnngagaggngnagccgntaggncngnngacagngnananataangaagnntcagnnancacgganannnaanaangnngnggggtngacgacggnngnacgcgn

SEQ ID NO: 1827 - DNA, 737 bp, Homo sapiens
  misc_feature (1)...(737): n = A,T,C or G
cnttttgnntcntattatatacangctacttgttctttttgcaggatcccatcgattcnaattcggcacgagtggaggaaagcagcagggtaaaacctggcgctgcaaaatgtgcaggctcgaatacggatggtcctcgcctatctgtttgctcagttgagcctctggtctcggggtgtccacngtgggctcctcgtgctgggatccgccaacgtggatgagagtctcctgggctacctgaccaagtacgactgctccagtgcggacatcaaccccataggcgggatcagcaagacggacctcanggccttcgtccagttctgcattcagcncttccagcttcctgccctgnagagcattctgttggcgccngccacccgcagaactggagcccttggctgatggacaggtgtcccagaccnacgaggaagatatggggatgacatatgcggagctctcggtctatgggaaactnaggaaggtggccaagatggggccctacagcatgttctgcaaactcctcggcatgtggagacacatntgcaccccgagacaggtcgctgacaaagtgaagcggtttttctccaagtactccattaacagacacaagatgaccacgctcacacccgcgtaccacgccgagaactacagccctgangacaacangtttgatctgcgaccatttctgtaccaacacaaactgnccttggcagattcggtgcataaaaaatnagtgt

SEQ ID NO: 1828 - DNA, 754 bp, Homo sapiens
  misc_feature (1)...(754): n = A,T,C or G
tatncgttacaactacttgttctttttgcaggatcccatcgattcgaattcggcacgagaccgggaccaaaacatnanccgcttggncntncaaaanaatcaacctgnaggatctcaggtttcntctggtctgtggggagggcaaaaaggntcgggtgatggccaccnttggggtgacccgaggcttgggagaccacagccttaaggtctgcagttccaccctgcccatcaagccctttctctcctgcttccctgaggtacgagtgtatgacctgacacaatatgagcactgcccagatgatgtgctagtcctgggaacagatggcctgtgggatgtcactactgactgtgaggtagctgccactgtggacagggtgcttgtcggcctatgagcctaatgaccacagcaggtatacaagctctggcccaagctctggtcctgggggcccggggtaccccccgagaccgtggctggcgtctccccaacaacaagctgggttccggggatgacatctctgtcttcgtcatccccctgggagggccangcagttactcctgaggggctgaacaccatncttccactacctcttcatacttactcctntacagcccaaattctgaagttgtctcctgacccttcttttantggcaacttaactgaagaagggatgtccgtttatncaaaattacactattggcaaataaccaagatggataaaaaaaaaaaaaaaaacccctttanaactatatgagn

SEQ ID NO: 1829 - DNA, 725 bp, Homo sapiens
  misc_feature (1)...(725): n = A,T,C or G
tttaaccnctntcgantcggcacgatggagaggccttggcaaaatggctcatcacgttcaggccctccgggctgagttgtcagcagtatcaagggaggggcctgctctatccccagaaggatcaggatcatatccaggatgccccacatacaccaagccaggcagagggcagctcagctcctgtcccatctgctttggatatctttacccaaaggcaggtaacccgaagagccagcctccactgcccacagagccaggcccagttgtgttggagtataggtcaggagctgtggaaggaggcagtctgtgagggactcatgctttaggagtcctcacccctcagactgctgcaggacattgccaggcctctctccacttccttcctcagcatacagacttcatgctatcttccaattccggggagtcttagctattagggcagtttctgcttctccattttggggacaaaggccttgcccagtacaaatctagccccttgtcccacagacttctggatggtataaacctagtggcaatgtagcaaccataggctagaaccaaacccaagatttgggtcagtgccctgttaagggttttaggattggtaaggacaccacagctaaatctgacatgtaaaaggataccctttccctgtcccactacgggtggaggctaaggaccttctcagaacccacagatggctggtgacattgggcacaaggctg

SEQ ID NO: 1830 - DNA, 756 bp, Homo sapiens
  misc_feature (1)...(756): n = A,T,C or G
annnnnntttttacntcgntcgaattccgtgctgtcgaattggtttggcacctactacaggatgatccagaccaacttcattgacatgggagaaacatggtttggacttggctgaaagaggagacagaagtggaaggaccttcctggagcagggccccttcgctttcagaagggccgtattgagtttgagaacgtgcacttcagctatgccgatgggcgggagactctgcaggacgtgtctttcactgtgatgcctggacagacacttgccctggtgggcccatctggggcagggaagagcacaattttgcgcctgctgtttcgcttctacgacatcagctctggctgcatccgaatagatgggcaggacatttcacaggtgacccaggcctctctccggtctcacattggagttgtgccccaagacactgtcctctttaatgacaccatcgccgacaatatccgttacggccgtgtcacagctgggaatgatgaggtggaggctgctgctcangctgcaggcatccatgatgccattatggctttccctgaagggtacaggacacaggtgggcgagcggggactgaagctgagcggcggggagaagcagcgcgtcgccattgcccgcaccatcctcaangctccgggcatcattctgctggatgangcaaccgtcagcgctggatacatctaatgagaaggccatccaggcttctctggccaaagtctgtgccaaccgcaccaccatcgtagtgn

SEQ ID NO: 1831 - DNA, 742 bp, Homo sapiens
  misc_feature (1)...(742): n = A,T,C or G
nncccntttntcnncnccganttccgntgctgtngctgganaatanctacgaagctgcccgatggccaggtcatcaccattggcaatgagcggttccggtgtccggaggcnctgttccagccttccttcctgggtatggaatcttgcggnntccacgagaccaccttcaactccatcatgaagtgtgacgtggacatccgcaaagacctgtacgccaacacggtgctgtcgggcggcaccaccatgtacccgggcattgccgacaggatgcanaaggagatcaccgccctggcgcccagcaccatgaagatcaagatcatcgcacccccagagcgcaagtactcggtgtggatcggtggctccatcctggcctcactgtccaccttccagcagatgtggattagcaagcangagtacgacgagtcgggcccctccatcgtccaccgcaaatgcttctaaacggactcagcagatgcgtagcatttgctgcatgggttaattgagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaactgttcccttggtattaacgtgtcagggctgantgttctggggatttctctagangctggcaagaaccagttgttttgtcttgc

SEQ ID NO: 1832 - DNA, 742 bp, Homo sapiens
  misc_feature (1)...(742): n = A,T,C or G
nnnnttttgaactccntntgagaaganaccgcagatctggtcagccatgcagggacacactctgtgttaccaagaactggctgtctgcagatactaaagaagagcgggatctctggatgcaaaaactcaatcaagttcttgttgatattcgcctctggcaacctgatgcttgctacaaacctattggaaagccttaaaccgggaaatttccatgctatctagaggtttttgatgtcatcttaagaaacacacttaagagcatcagatttactgattgcattttatgctttaagtacgaaagggtttgtgccaatattcactacgtattatgcagtatttatatcttttgtatgtaaaactttaactgatttctgtcattcatcaatgagtagaagtaaatacattatagttgattttgctaaatcttaatttaaaagcctcattttcctagaaatctaattattcagttattcatgacaatatttttttaaaagtaagaaatctgagttgtcttcttggagctgtaggtcttgaagcancaacgtctttcangggttggagacagaaacccattctccaatctcagtagttttttcgaaaggctgtgatcatttattgatcgtgatatgacttggtactagggtactgaaaaaaatgtctaaggcctttaccagaaacatttttagtaatgaggatgagaactttttcaaatagcaaatatatattggcttaaagcatgang

SEQ ID NO: 1833 - DNA, 1073 bp, Homo sapiens
  misc_feature (1)...(1073): n = A,T,C or G
caacnncancccnncccnncnanncnncnnnnnacannancnnnaccnnaannangnnnccncnnncatactacatnncnncncacncncncnccnanacnngancacnnnnncacannnnncgacncncncncncnccaacncactccnnctcacnccagaacnnctccnancacacacnanatatnangnnactcacctcanctctatncnnacgncncnacannccccnannnngnncctttttgaaacccctttcgaaanccncgtggccggnnaaataagcanactggacgncngtannatgtctnttcggcaaagnantatnnctnnaccaaanctagctngtgactnatcncgcagtcataagacantcctaacatngtgactgtnaaagncttggagatggccgcnnggctcctgnatcgactccgtcattantncncatgcaacaaaatacgagccngagttnatnntaaaangngaaaagcnacncnaangaaactcactccattacgtggngaanataaggaagtnatcanagcatnnccnannatcanataagtaacccatcaatgagcaatgccaaagaatactatntgaacngcncnctctctcngctntnaatttggaaatgaggccntgctacgaaaacaactnccaanaaacaacanacctcaangcnaancccaagagggcaagacttnatcnannatagcacccccagagaaaaaccacctaacgactacnnggtacngaagaanttcccttgcggcnnggaaaaacagatgaacangnttgcngaaaaggcncnancnnatgtattaagccannctcagccantaccgagagntacnagaaggacnactcgnncgccccnaagtacctggtanactgncncanccgaaccnggctnaaacanacantccnatngctcccnnncccacnntcncncccccnggnccngcnctnnncccnnanancacnannncangatncccnnntcnntnccctacncncnacccggcccccactanncanccnnctgnnctcnnccccccgacncnctaccn

SEQ ID NO: 1834 - DNA, 749 bp, Homo sapiens
  misc_feature (1)...(749): n = A,T,C or G
nnntnnnnntttgnaacccctttcgaatccgttgctgtcgctgattaatgcactttgaagttctctggaattaattattttaacttggcctagcttcgactgtcaaggtggctgttataaatttgacttcattggcagtggatgaagcctaagccagctgagtctctatcatagctgaaccctgaggacagcctcatagctcatgtatcagggacttttgccacatttcagaggcatagcatgaacaagtaatattaagccaagaataagcagcagaaccctgttccatatggaaaaaagaaaaacaattttttgtccctaatgttcttccttttacatcctggaacaacaataaaaacatttttttaaacttgtctactgtaagatactgccatcataaagcagagacttacatgagtgaaagggttgcctcatcaagcagctcagtgtaaatggggaggctaggctctccccagccctatggtttttttatttcatgtaccccaggaaatactgtgtggtttctaaaagccctggttgttaaaagtagggactctgcctttttgttggtagggagaaaaaacgctattgctttgtcttacagagcgaatgtctgccaactacccgttcattatataagtctgaacttggtaatantatggctaatgaagattaagccctctataaagacttcctgttgaggtgaattctcatactgaaatgtacttacctacaatatttactagagn

SEQ ID NO: 1835 - DNA, 752 bp, Homo sapiens
  misc_feature (1)...(752): n = A,T,C or G
ncnnnnttttaacctcgntcgaattccttgctgtcgttaattgttggctcagtgtatgctggggacaaagaaaaactaacaagccgacctgcctttatgataaattctagtgtgcttacaagggatgacttcctgaggtgtgatctgtccaccttgaagaactccacaactgaagaaggggagctgtgagaacgtggattgttctacaacttgcacagggtaacagaggaagtggctgaggcctagagtcacgttttccagttcccttcgcaaactatatttcttggaacgcgaaaggaagctttacctatttcatagaagacctggaatccataacctcagaaggcaatattattgatagaaaatgtggaaggatcaggaagttcttagattcttggatgacagatgcatgttgatgccctatggagatgtccttgtgttttgaggtcactgaggtaggaagacctgtctactcttggtttcaccactagaacagtcttgggctggatgggttatagagctgagcggctgtgatggttctgtttttacattaacaaaaacaattaaaaacaccaaaaacaaanaanaaaannnnaannaaaaaaaaantttnnggggnccttttttcccnnanncccnnccnttnnaaaaaccctttgnnaantttgggaaaccccccnnttnaaaatnntnnnnnnnnnnnnnnnnnnnnnnnnnntnnnnnnnntnntnnnnnnnnnnnnntnnnnncc

SEQ ID NO: 1836 - DNA, 750 bp, Homo sapiens
  misc_feature (1)...(750): n = A,T,C or G
nnnnnnntttgaaaccccncgtgagagcctgagcagcaaatctctcgcgacaccctgtacgaggcggtgcgggaagtcctgcacgggaaccagcgcaagcgccgcaagttcctggagacggtggagttgcagatcagcttgaagaactatgatccccagaaggacaagcgcttctcgggcaccgtcaggcttaagtccactccccgccctaagttctctgtgtgtgtcctgggggaccagcagcactgtgacgaggctaaggccgtggatatcccccacatggacatcgaggcgctgaaaaaactcaacaagaataaaaaactggtcaagaagctggccaagaagtatgatgcgtttttggcctcagagtctctgatcaagcagattccacgaatcctcggcccaggtttaaataaggcaggaaagttcccttccctgctcacacacaacgaaaacatggtggccaaagtggatgaggtgaagtccacaatcaagttccaaatgaagaaggtgttatgtctggctgtagctgttggtcacgtgaagatgacagacgatgagcttgtgtataacattcacctggctgtcaacttcttggtgtcattgctcaagaaaaactggcagaatgtccgggccttatatatcaagagcaccatgggcaagccccagcgcctatattaaggcacatttgaataaattctattaccagttcaaaaaaaaaaaaaaaaaaatttcntgnggcccttttnn

SEQ ID NO: 1837 - DNA, 749 bp, Homo sapiens
  misc_feature (1)...(749): n = A,T,C or G
nnnnnnctttgaaccctttcgaattccgttgctgtcgtgcctccaagatggtgagtcttcttgcgtggtgagggtgggggttcgggtgcagactctgggattgtggggaagtgagagcctggagcacggctgaggggtggaccgagtgtacatttcatttgctctgggggtcggcgggatttgcggagaaacaggagatccgagcggcgccttcctggaggctgccggtgcggcttgtggccggaaagggactgaggctgggtgagttgcgccgttttcctaacagttttcccatcctgtcgcagacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatggtaagtgggtcaccggcgcgaactgtgtgaggatcccagtatcttaaagccttcgcccaacttcgcccttttggaggctctgttcgttggagcctctcaggcaatttccacgtatttaangttgttactggtagaagagaattctcttgtttgccgtttngattcttttctggncagaaggtgacttttgtgatagagtgcacaagcctttactctgaggtaaanggttgctgtttcggttattaagattgcnaaaactanaaacc

SEQ ID NO: 1838 - DNA, 770 bp, Homo sapiens
  misc_feature (1)...(770): n = A,T,C or G
tttaatcaataantgctacttgttctttttgcaggatcccatcgattcgaattccgttgctgtcgccggagcgcacccggccggaagccgctgtcggggagccggcggtggggctggacgcaggtgcaactgacatgggtgaaccccagggatccatgcggattctagtgacagggggctctgggctggtaggcaaagccatccagaaggtggtagcagatggagctggacttcctggagaggactgggtgtttgtctcctctaaagacgccgatctcacggatacagcacanacccgcgccctgtttgagaaggtccaacccacacacgtcatccatcttgctgcaatggtggggggcctgttccggaatatcaaatacaatttggacttctggaggaaaaacgtgcacatgaacgacaacgtcctgcactcggccttcgaggtgggcgcccgcaaggtggtgtcctgcctgtccacctgtatcttccctgacaagacgacctacccgatagatgagaccatgatccacaatgggccttcccacaacagcaattttgggtactcgtatgccaagaggatgatcgacgtgcagaacagggcctacttccagcagtacngctgcaccttaccggtgtcattcccaccaacgtctttgggccccacgaacaactttaacatcgaaggatnggccacntgcttgcctgggcttcntccacaaggtgcaccttgggcaanaancaacggnttcggnccttgacggtgttggggg

SEQ ID NO: 1839 - DNA, 753 bp, Homo sapiens
  misc_feature (1)...(753): n = A,T,C or G
tttgaaanccctttgctacttgctctttttgcaggatcccatcgattcgaattccgttgctgtcgctttgaaatgtaacaaatggtactacnaccaattccaagttttaatttttaacaccatggcaccttttgcacataacatgctttagattatatattccgcactcaaggagtaaccaggtcgtccaagcaaaaacaaatgggaaaatgtcttaaaaaatcctgggtggacttttgaaaagcttttttttttttgagacggagtcttgctctgttgcccaggctggagtgcagtagcacgatctcggctcactgcaccctccgtctctcgggttcaagcaattgtctgcctcagcctcccgagtagctgggattacaggtgcgcactaccacaccaagctaatttttgtattttttagtagagatggggtttcaccatcttggccaggctggtcttgaattcctgacctcagttgatccacccaccttggcctcccaaagtgctagtattatgggcgtgaaccaccatgcccagcccgaaaagcttttgaggggctgacttcaatccatgtaggaaagtaaaatggaaggaaattgggtgcatttctaggacttttctaacatatgtctataatatagtgttaaggtcttttttttttcaggaatcatttggaaaatcaaaacaattggcaaactttggattaatgnggttaaagtgcagganacattggtattctgggcaccttcctaa

SEQ ID NO: 1840 - DNA, 755 bp, Homo sapiens
  misc_feature (1)...(755): n = A,T,C or G
aacntcggntcaacccntgctggtgtttanatgtaacntnngntnctncacccaatnccagtcttctntttttnacaacatggccccaaaaagcaaccagggctatttgtacagttgaaggggtgaacagaatgggcggctgtgctgggagttggaagacngggcagnaccgctattnagagccatccctnactcagctggcagggacaagccaacgccaggtagcatgtggccacccttgcccantgtctgtggcctggcaagtggccacgccctgtgtcanaccatctgggaattaagctccagacagacttacagatgccttccttaggagttcttgcttcttgcgttgatactttgccccanaaaggcctgggattcattctggnncttatcagggtgtgtccacnctctgctnacaggnggatccnccggctttcagtgcngacagnccagatgcttcctgcagcccangccccgggcaccttctgnaaccatnttgggctnaagacctgaagccggtttcctnggtccccntttccaacaagccttcaccaacaaagcttnggccaaannnttnccnttcnggttgnttttnacccngcttngggcctncnagcnttgaancttggaaaannaantttttcccgaaanttgtttntgggaaacccnagggcnaanggtttttaagggaaggtccnaaaaggnnnttccggggcnggnaaaccaagnccccaaggnttntaaacaaggcc

SEQ ID NO: 1841 - DNA, 838 bp, Homo sapiens
  misc_feature (1)...(838): n = A,T,C or G
tactcgatcgantcgtgctgtcgtcacggtactttgcccaagtcaccccgangtcangcgttanancaggaattnganccccaaagcttanctnttanccntttngntaacnggntgtntttccaggcccccntnaccntttcnntnaccntcccntgccccaggggcntcntntcaaanggcngttcccccntcgnttgcntcagcntntccantttaaagcttcntggntctcctcntgttgaagtcntgggatggntttcccntntcanaaactgcncaanaaacaaccttggagttttgaacaaaggntattcaaggagtnttcaagaatgaatcttcntaatcgtggtcatgagacatgagaaaaaaggtgtctaccacgtcttgtctctactcataaagacattggccaggtgcggnggctcacgcctgtaatcccagcactttgagagggcaaggtgggcggatcacctgaggtcagaagttcaagaaccagcctggccaatgtgacaaaaccccatcttntatnaaaatacaaaagttaactgggtgtggtggcangtgcctgtaatnccaacttcnttgggangcgaaggcaggaagaattgctttgaaccccgggaggcggagccttgcantgagctgaaaatcacacttactggactttcaacctgggggtaccaaaanggganggcttttgctttaannaaaaaaaannnnnnnnnnaaaaatttccttggggggccggnttttttttcggnnnaatnccccanctttgtaaaanaaancctttgggnggaggtttnggggaaaaaaacccnccnnnnnntttttt

SEQ ID NO: 1842 - DNA, 753 bp, Homo sapiens
  misc_feature (1)...(753): n = A,T,C or G
nnnntnttgtttgaacccntttcnatnccgtgctgtcggtcacggtactttgcccaaagtcaccccgatgtcaagcgttagagcaagaatttgaaccccagagcttaactcttaaccattttgctaactggctgtctctccaggcccccatcaccctttccatcaccctcccctgccccaggggcatcctatcaaatggcagttcccccctcgcttgcctcagcatctccaatttagagcttcatggatctcctcctgttgaagtcatgggatggatttcccatctcanaaactgcacaagaaacaaccttggagttttgaacaaaggatattcaaggagtattcaagaatgaatcttcataatcgtggtcatgagacatgagaaaaaaggtgtctaccacgtcttgtctctactcataaagaacattggccacgtgcggtggctcacgcctgtaatcccagcacttttgagagggcaaggtgggcggatcacctgangtcagaagttcaagaccagcctggccaatgtgacanaaccccatctctataaaaatacaaaagttagcctgggtntggtggcaggtgcctgtaatcccagcttccttgggaggcgaangcngganaattgcttgaaccccggtaggcgnngctttgcattgagcttanaatcacactactgcactncaatcntngggtncaaaagggaggctttgctanacnanaatcnntaanaaanttccgggncccnctttn

SEQ ID NO: 1843 - DNA, 748 bp, Homo sapiens
  misc_feature (1)...(748): n = A,T,C or G
nnnnnnnnnttttnnaccttcgnttcgaattccgttgctgtcggacatcacagcccctatgaagaaagtagccacaatctcaaataacaaaagggaatgttctaaaactttttcttccttaaaaatggagaaaattgcacttgtgcttgctgtgtggtatataaaccaggattagtcccagggtcgtgaggtttctggtgaaaaggttaaatcgtagaagctagtatattttttatatttttgtaacaattgcttttttcatgggggaggcggggttagtatttatagtcctaacaagtccagtaattttttataaatcttcagattataaacagcccctaaaaactttacaacgtttacacagttttttaaaaagagactgtatacacttgatttgctttcaaaataaataaggtcagctagtctaggaggttaacgtcgggtaggaatgctgatcatgataggtttggttttctacagattctgttccggtgcctttcctatccaggcaccacctgagaaagttgtcatttgaggtcgcacttggaagttacatctgtgaagtttctgtcattcgtccagatctgtgtgtgtagcatgtgctgaggaagcacgtgctgggctgtgcctcagacagtgcatcaccgggcacccagaggcttgcctggctattcctgttctggtgtgtgtggagtgttggggaggaacagatgcagatcaacctgtggctgtttcccgtctaggttct

SEQ ID NO: 1844 - DNA, 843 bp, Homo sapiens
  misc_feature (1)...(843): n = A,T,C or G
nttcgattccgtgctgtcgggctgtacaaaaggtagacataatagtgagaagccacctgagccagtcaaacctgaagtcaagactactgagaagaaggagctatgtgaattaaaacccaaatttcaggaacacatcattcaagcccctaagccagtagaagcaataaaaagaccaagcccagatgaaccaatgacaaatttggaattaaaaatatctgcctccctaaaacaagcacttgataaacttaaactgtcatcagggaatgaagaaaataagaaagaagaagacaatgatgaaattaagattgggacctcatgtaagaatggagggtgttcaaagacataccagggtctagagagtctagaagaagtctgtgtatatcattctggagtacctattttccatgaggggatgaaatactggagctgttgtagaagaaaaacttctgattttaatacattcttagccccaagagggctgtncaaaagggaaacacatgtggactaaaaaagatgctgggaaaaaagttgttccatgtagacatgactggcatcagactggaggtgaagttaccatttcagtatatgctaaaaactcactttccagaaccttancccgagttgaagccaaatttgcccatttggttaantggngcattatttggaattttngaaagggncannaaagggaatttttggatccaaaaaatngtggaaaatttnnttggggggnttgtggaatntggaatgntnaaaanccnnaanntttttgttaancntatntgacctnggcnnaccnaangtatttgggaanttccccttttttgtnaataaaaaaagnct

SEQ ID NO: 1845 - DNA, 815 bp, Homo sapiens
  misc_feature (1)...(815): n = A,T,C or G
ttactttnaacccttgcnantccgggctgtcgggctgtacaaaaggtagacataatagtgagaagccacctgagccagtcaaacctgaagtcaagactactgagaagaaggagctatgtgaattaaaacccaaatttcaggaacacatcattcaagcccctaagccagtagaagcaataaaaagaccaagcccagatgaaccaatgacaaatttggaattaaaaatatctgcctccctaaaacaagcacttgataaacttaaactgtcatcagggaatgaagaaaataagaaagaagaagacaatgatgaaattaagattgggacctcatgtaagaatggagggtgttcaaagacataccagggtctagagagtctagaagaagtctgtgtatatcattctggagtacctattttccatgaggggatgaaatactggagctgttgtagaagaaaaacttctgattttaatacattcttagcccaagagggctgtacaaaagggaaacacatgtggactaaaaaagatgctgggaaaaaagttgttccatgtagacatgactggcatcagactggaggntgaagttccattcagtatatgctaaaaactcactttcagaacttacccgagtagaacaaatagcacattggtaaatgtgcatattgttttggaaggagagaaaggaatttnatcaaaatggtgaaaattatttggggtgtggattggatgttaaaagccgaaagttttgttacctnttgactggcaaccaaaagaattgnaatcacttntgagnaaaagcttgaacccgatgccagt

SEQ ID NO: 1846 - DNA, 801 bp, Homo sapiens
  misc_feature (1)...(801): n = A,T,C or G
gnnttnnaccncgnatcganttccgttgctgtcgctgacggcgcttttgtctccgggtccagaggcctttcagaaggagaaggcagctctgtttctctgcagaggagtagggtcctttcagccatgaagcatgtgttgaacctctacctgttaggtgtggtactgaccctactctccatcttcgttagagtgatggagtccctagagggcttactagagagcccatcgcctgggacctcctggaccaccagaagccaactagccaacacagagcccaccaagggccttccagaccatccatccagaagcatgtgataagacctccttccatactggccatattttggaacactgacctagacatgtccagatgggagtcccattcctagcagacaagctgagcaccgttgtaaccagagaactattactaggccttgaagaacctgtctaactggatgctcattgcctgggcaaggcctgtttaggccggttgcggtggctcatgcctgtaatcctagcactttgggaggctgaggtgggtggatcacctgaggtcaggagttcgagaccagcctcgccaacatggcgaaaccccatctctactaaaaatacaaaagttaaatacaaaagttaacttgggtgtggtggcaaaagcctgtaatccagcttccttgggaagctgaaggcnggaaaaaatgcttggaccccggggaccgaggttacaagtgagccganatcgcacttggtgtacccaagcctgggncccagtgcaagaatccttttcaaaaaaaaaaaaaaaaa

SEQ ID NO: 1847 - DNA, 788 bp, Homo sapiens
  misc_feature (1)...(788): n = A,T,C or G
gnnnnnnnnnnnnnnttttnnaactcgntcgaattccgtgcttgtcgctgncggcgcttttgtctccgggtccagaggcctttcagaaggagaaggcagctctgtttctctgcagaggagtagggtcctttcagccatgaagcatgtgttgaacctctacctgttaggtgtggtactgaccctactctccatcttcgttagagtgatggagtccctagagggcttactagagagcccatcgcctgggacctcctggaccaccagaagccaactagccaacacagagcccaccaagggccttccagaccatccatccagaagcatgtgataagacctccttccatactggccatattttggaacactgacctagacatgtccagatgggagtcccattcctagcagacaagctgagcaccgttgtaaccagagaactattactaggccttgaagaacctgtctaactggatgctcattgcctgggcaaggcctgtttaggccggttgcggtggctcatgcctgtaatcctagcactttgggaggctgaggtgggtggatcacctgaggtcaggagttcgagaccagcctcgccaacatggcgaaaccccatctctactaaaaatcaaaagttaaatcaaaagttagctgggtgtggtggcaaaaggcctgtaatcccagcttccttgggaagctgangcgggagaattgcttgaaccccggggacngaggttacagtgagcccagatcgcactgttgtacccanctggggccacagtgcaagaattcat

SEQ ID NO: 1848 - DNA, 764 bp, Homo sapiens
  misc_feature (1)...(764): n = A,T,C or G
actngntcnnatccgntgctgtcgnngnttagagttaaaagtcaataagcattacaaaaattgccattttgacatcagcaaatcaaatttctctatctaattaaaggaaaaccctttctcttatttctcttctcttttcctcttctcttcctcctcctctatttcccctctccttatccccttgtctccctcttctgctctttctctacttcctctntctcttttnctgatgtatgnctatnntatattttcagaaataattcagtggcatctcatgtagatgtaccactttcttattgcaactcagagtgcaattgtgatgaaagtcantgggaaccagtctgtgggaacaatggaataacttacctgtcaccttgtctagcaggatgcaaatcctcaagtggtattaaaaagcatacagngttngatactgtagttgtgtggaagtaactggctccagaacagaaatactcancncacttngggtgaatgcccaagagatantacttgtaccaaggaanttttcatctatgttgcaattcaagtcataaacctctttgttctctgcaacaggaggtaccacatttatcttgttgactgtgaagattgttcaacctgaattgaaagcacttgcaatggggttttccagtcaatggttataagaacactagggaggaatctagctccaatatattttgggggctctgattgataaaaccatgtatgaagtggnccaccaacagctgtggagcccaaggagcttt

SEQ ID NO: 1849 - DNA, 871 bp, Homo sapiens
  misc_feature (1)...(871): n = A,T,C or G
ctcgntcgattccgtgctgtcggagctagatggactaggagagacttgattttggtgctaaagttccccagttcatatgtgacatctttttaaaaaaaataacaacaaaaaaaaanngagagaaangctaaaaaaaaangtagggggtgaccagttaagggtttnnattccncatncaatatcngggtaaaacgattncctgtaaaagtagcttnaanggttttngctctaaaatnccgtaggtctatccttagagcactcacgccatgctttcttccctgggtttnaaacttcatataactttcanaaatnggagagcaaaaatttngctngtcactgcacatcaatttaaaaaagcttatttaacttatcaaaacgtntttattgccaaactatgctttttttggtaaatttgnccatattaatcgggatgacaaatccatagaatntatcctttnatgtnaaattatganctcatattaatcttaaaattttgngacgngtcttttccctttttttccacagtttaaatatataattcttaaccgacatttttnggaacctttacactttttngggtaatttaanttttaaaaaaaaattgaaaaaanttaaattttaaaaaaaaatggccnaaaaaaccctggtngggaattaatttaaatttttnaaaaaaattttccccccccnttttgggggtttggggaacctggccaaaaattgggaagntttnncnttttnccnnntttttaaagggncccttttttncaccaaacctttgggggaccctgggaaaaaantgggnnnttnggtaaaaaaaagnttnncntggggggaacccnggntncccccnnnaaagggggnaaaannc

SEQ ID NO: 1850 - DNA, 936 bp, Homo sapiens
  misc_feature (1)...(936): n = A,T,C or G
ttgnancnctttcgaatccgtgctgtcgcgggtgagtgagagagttggttggtgttgggccggaggaaagcgggaagactcatcggagcgtgtggntttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgntgaatttgaagatccccgagatgcagctgatgcagtccgagagctagatggaagaacactatgtggctgccgtgtaagagtggnactgtcnaatggtnaaaatngaagtttgaaatcgtggcccaccttcctcttgggggtcgtcgccctngagatgattatccgtatgaggagtccntccacctngttncanatctccaanaanggagaaagctttttnttcncancccggnagccaangtccccctttttctagnagaattnggannaantaattagtangantcctctttgttttcggggnannanaaaaaattcnnccaaaganccngttccnccggantcccttttcttcctaaggggtctttccggtaanttccgnantccntatgggctccaaaanttggaaatnggggtaattttatgcaactctaccaagtttttggtcaanctaaaaaaanttnggntttgtcncccnggggaaaaatttnncttttaatttnttnancccgngaactttttgnttcccctgaaaanttttccaaagntttnnggtttttnnaaaaanttttanttaaaacntttggncccccantttttttaaaannatgtttttaaaatcctgtgttctcnaaaantctngttttngcct

SEQ ID NO: 1851 - DNA, 756 bp, Homo sapiens
  misc_feature (1)...(756): n = A,T,C or G
gtnanncctnngangcggcagnctgcttntngccaancagtcctattgngaggtctnggctatcaggccagntgtnanaccactccatgcactgggtgtgctctgtnggncagggnctgggagggaaactncctntccttcccttaaccaagcatgaattatgtttgttagcaaacctctctgggaatatatgtcaagccacattcctcctggggcagctgcaacttcagggcttcacaataaacagttctgaaaaccagatattatctgcaatttagcatacagcatggaattatgatacataattcactatgcttcagagaatagggctgcaagaagataaaataagggttttaattcccagctatctctctcaaattttaagagagatgttatggactgtgctctccccacaacccggcccataagtcgcatgttgaagttcttacctctagtaccttggactgtgactatatttggaaacagggcctttaaagagacagttaagtgaaaaggaggcctttagtatgggcctagtgtaatctgccagcccttatcagattaataaagntaaatacncngaaagatccngagatgcnttagcgcaangaaagacatgtgacncaccaagagaagcagccatagcaaccaaaacagtggccttagaanaatcaaccctgcngtccttgtcttggactttcacttccaaatgtaagaaagaactcngatgttaagcatcctctgngaatttgttgg

SEQ ID NO: 1852 - DNA, 762 bp, Homo sapiens
  misc_feature (1)...(762): n = A,T,C or G
tcgtctgaancgggcagcactgtcattcatagccaaacagtcctattgagaggtcttggactatcaggccagctgtcagaccactccatgcactgggtgtgctctgttggtcagggactgggagggaaactacctctccttcccttaaccaagcatgaattatgtttgttagcaaacctctctgggaatatatgtcaagccacattcctcctggggcagctgcaacttcagggcttcacaataaacagttctgaaaaccagatattatctgcaatttagcatacagcatggaattatgatacataattcactatgcttcagagaatagggctgcaagaagataaaataagggttttaattcccagctatctctctcaaattttaagagagatgttatggactgtgctctccccacaacccggcccataagtcgcatgttgaagttcttacctctagtaccttggactgtgactatatttggaaacagggcctttaaagagacagttaagtgaaaaggaggcctttagtatgggcctagtgtaatctgaccagcccttatcagattaataaagttaaatacacagaaagataccagagatgcattagcgcaaaggaaagaccatgtgagccncacnaagagaaggcagcctnggcaagcccaagaacagtggccttagaagaaatcaacccctgccagtacccttgatcttggaccttccagctttccaaaattgtaggaaaaggaactcctgaggttnaann

SEQ ID NO: 1853 - DNA, 788 bp, Homo sapiens
  misc_feature (1)...(788): n = A,T,C or G
tactcgatcnnattcgnaaccgtgctgtcgcattaactttcagtttccccatgttacttttgtaacagggatttgagaccttaaactgttcatcaaagtaagccctaatagaaaggcagagcaataagagcacatgctgatgtaattctcctttgcaaggagaatttcatttagttccattgtcatatagaccagtgtcaccccttttccctgattcctactgttaacaactatttttcagtgcctttgaagatactgacccttctacctgcccagctgtttttaaacagctggagcgtgatgatggtcataaaatatataagtgttttagcatgtacagtaaaactaggttgtttagttaaacatagagttttgcctactttttcaattcgtttgactgcaggtgtggtcatttagttgcaaaccatttccatagtctgcttccactgtccagttaatctgtttttttccccttctatcatctgagcattcatctgtcatttccttcttttttatttatttatttatttatttatttatttattttggagatggagtctcactctgtcgttcaggctggagtgcagtggtgcagtctcagctcactgcaatctctgccttccaagttgaagcaattctnctccctcagcccttcctagtagctggggattacaggtgtggtatcaccatccttggctaatattgtnttttaanaagagatggggngncactatgttggtcangctggccttgaactcctgacctcaggggaatcttcctccttggcc

SEQ ID NO: 1854 - DNA, 994 bp, Homo sapiens
  misc_feature (1)...(994): n = A,T,C or G
tngntngacgntgagagacngtgtaaggcgtgntanagcgagnctatttcattacgtgncanccctnttatcagtaataccnaacgacttgccatggagtcacagcgctgtgctacganccaggnnatcagccctaggagggccnctnaggggagaactaggtgtncagaaancngtatgtggtgaaantctngngnganggtgtgggntnngantacntagngnntatcctnnnancacttannnnnnncntttnnccnngggnntgaaatnncanangccttngacaaatnngagngccaaagtntnggnnnnanctgnnccttnnnaanannnnncttgtgtncttaccaaacgnnatttnattgcccnactnatcnntnnancnntgttanntttcngacnantttcntgnnnntcnncaacacccntcttaaatattacctnccttntnatgntgaantttannganancccccntntcattanaccccnatacaanaattntntnncncntncatcgntnnnttatatcccccctnatttctttncgncccctcctnatntgcttgacaanacattgtgnntcnnnannntnttttaaancgnnccttctctntctntactcgggaaaanactctttntcacacantctnttttacttntttgggggggcataaatctcctaaaatctntctccncaanacgaacaacanagcgttctcaaantnggcantntaanactcttctcttacaaaaantnttcgngcnccnnnanatcaatctccntgcncncnggganttttcncttcatctantttcttgngggatnaaaaatttcaccccccncttntcttngcgtcttngctnnntannctcanatnnggnggnttgnnttntctcctcctctttacgggctcnntccccaanntttngnnncntnnnaanntttntcnttaaanctncttnngccnncntcccaaacagnaaaann

SEQ ID NO: 1855 - DNA, 914 bp, Homo sapiens
  misc_feature (1)...(914): n = A,T,C or G
ttctgcggacgctcccgcggagcggaaacctcattgtggtggagagcgtgctcatggcngtggccttcctgggccatgctgatggtgctgggtttgngcggagccgcttaccggcccacggaggagatcgatctgcgcagcgtgggctggggcaacatcttccagctgcccttcaagcacgtgcgtgactaccgtctgcgccacctcgtgccttnctttatctacagcggcttcgaggtgctctttgcctgcactggtatngcctttgggctatggcgtgtgctcggtggggctggagccngctgccttaccctcctcgttgcttacagcctgggccgcctcatccncctcactcntgggcctgnntgngcctgtggctgccacgcccggtgcccnggtggctgnagcaagggnttgcacctgctagctcacccttcantcctcttttttnctggggcccccctgcgccctntngngtccctgcaacacaancntggaatccttcatatgttngnantcatggncccntttcggaggcnnngggncnagtcgtccctgnaacaaagaactttgggncttcnatcancaatcttcnatgggggaaaaatctttggntatccaaananccnttcggnaacannanctnnggcaanctntcacanncttcttnanccantctctntaacncanacnttggtttngnacaaaggtatcttagtntgggcncaaantatttcnnacccgngncgttcancccctnggggnncntttctctnaatncccttgtctctannncttnaataaaggngccctctaaaacacncntgnncntcacatctctcacatctagtttctacnnatgnanactgcactctctgttctcnggactngcgtccnttcacttctttnttcct

SEQ ID NO: 1856 - DNA, 804 bp, Homo sapiens
  misc_feature (1)...(804): n = A,T,C or G
nattcnaccncgntcggcccgggacctcagcggcttcaacaagacggttctgcggacgctcccgcggagcggaaacctcattgtggtggagagcgtgctcatggcagtggccttcctggccatgctgctggtgctgggtttgtgcggagccgcttaccggcccacggaggagatcgatctgcgcagcgtgggctggggcaacatcttccagctgcccttcaagcacgtgcgtgactaccgcctgcgccacctcgtgcctttctttatctacagcggcttcgaggtgctctttgcctgcactggtatcgccttgggctatggcgtgtgctcggtggggctggagcggctggcttacctcctcgtggcttacagcctgggcgcctcagccgcctcactcctgggcctgctgggcctgtggctgccacgcccggtgcccctggtggctggagcaggggtgcacctgctgctcaccttcatcctctttttctgggcccctgtgcctcgggtcctgcaacacagctggatcctctatgtggcagctgcccttttggggttgtgggcagtgccctgaacaaagactggactcagcacaactcctgggaatcttgtacgaaaaccaaggaagaaacanggacttcatcttcaccatctaccacttggtggcangctgngggcatctttaaccgngtacctgggcttcgaaccttgcacatgaaggctaaacttggcggtgcttgctggtgaacctggtggcgggccnctatctacgtaaaatcccaaacttgataagaaacctttgatgan

SEQ ID NO: 1857 - DNA, 803 bp, Homo sapiens
  misc_feature (1)...(803): n = A,T,C or G
tnattcnaccncgntcgantccntgctgtcgaataaaagcaaacagaacactccaacttagaagcaataacggctgccgcagcagccagggaaagaccttggtttggtttatgtgtcagtttcacttttccgatagaaatttcttacctcatttttttaagcagtaaggcttgaagtgatgaaacccacagatcctagcaaatgtgcccaaccagctttactaaagggggaggaagggagggcaaagggatgagaagacaagtttcccagaagtgcctggttctgtgtacttgtccctttgttgtcgttgttgtagttaaaggaatttcattttttaaaagaaatcttcgaaggtgtggttttcatttctcagtcaccaacagatgaataattatgcttaataataaagtatttattaagactttcttcagagtatgaaagtacaaaaagtctagttacagtggatttagaatatatttatgttgatgtcaaacagctgagcaccgtagcatgcagatgtcaaggcagttaggaagtaaatggtgtcttgtagatatgtgcaaggtagcatgatgagcaacttgagtttgttgccctgagaancangcgggttgggtgggangaggaagaaagggaagaattaggtttgaattgcttttttaaaaaaaaagaaaagaaaaaagaccgcctctcctnttgttgcccaagctcatctttganaaaccangcngtttgggtggggaggagggaaaaaaangggaanaattanggtttggaattgnntttttaaaaaaaaaaaaaat

SEQ ID NO: 1858 - DNA, 739 bp, Homo sapiens
  misc_feature (1)...(739): n = A,T,C or G
tcgntcagnnccgtgctgtcgaataaancaaacagacactccaacttagagcaataacggctgccgcagcagccagggaagaccttggtttggtttatgtgtcagtttcacttttccgatagaaatttcttacctcatttttttaagcagtaaggcttgaagtgatgaaacccacagatcctagcaaatgtgcccaaccagctttactaaagggggaggaagggagggcaaagggatgagaagacaagtttcccagaagtgcctggttctgtgtacttgtccctttgttgtcgttgttgtagttaaaggaatttcattttttaaaagaaatcttcgaaggtgtggttttcatttctcagtcaccaacagatgaataattatgcttaataataaagtatttattaagactttcttcagagtatgaaagtacaaaaagtctagttacagtggatttagaatatatttatgttgatgtcaaacagctgagcaccgtagcatgcagatgtcaaggcagttangaagtaaatggtgtcttgtagatatgtgcaaggtagcatgatgagcaacttgagtttgttgccactgagaagcagccggttgggtgggaagaggaagaaagggaagaattaggttgaatgctttttaaaaaaaaaggaaaggaaaagacagcatnttactntgttgccaaggctcatcttgagaaacagccngttgggttgggaggaggaanaaagggaat

SEQ ID NO: 1859 - DNA, 786 bp, Homo sapiens
  misc_feature (1)...(786): n = A,T,C or G
tactcgtacnnnnnccgattccgngctgtcggaagaacataaacaggatgctgagagattgggtctctccacattgccccggctgctctccacccctgagttcaagtgattcacctcccttggcctcccaaagtactgggattacaggcgtgagccaccgtgcctggctgagaagatggatttaagacatattttggaggtaacattgtcaggacttcctgaaggattagatgtggaagggaaggataagaaacagaccaaggataactttcaaatgtatgcttaagcaactggatggataatgatgccattgagtgagtgaaaaacttgatggaagtggaagattcagagttcatttctatctaggttaatttgagacataccagagcataagttaagtaagtaattgaatattggagtggagacttatttgtctaccgaattattgttttctttgtcggacatacacctacactgcattcctcaaagtaaaatttaagtgtggctctgtgcctatgctctccccagcggaaagtgaccagaagaggtgtgcagtttccaggcctggcccatacagacctccaacangtgctcccctgtgctgttactccttctgccactggaagcagatggtgaccagctctggaanaangcaaggcctgaagatgggagattcctaagtggaggagaactgngcccttctgacctaaatatncactcatattggtatgtgaagaataaataaaccttgtgttgacccnttaaaaaaaaaaaaaaaaaaaaaat

SEQ ID NO: 1860 - DNA, 1431 bp, Homo sapiens
  misc_feature (1)...(1431): n = A,T,C or G
cgnnggccnnngngnnnnnanngaaaagnnannnnnannnnnnnnnnnnnnnnnngnanagaanangnnnnncnnnnnnnnnnnnnnaagnagannnngnanncaanngnnnnnagagaanggngcacgagannnnaccnggcgagaanannncggngagagnaanngtcnaggnnnannnnnnannnnnnnggnngntatgacgtnnaaacccttcgggnnagacangnccgccagtatggccaggctgggggacnnaactnggcggactacgggnagaccnggncgnttttggcctcttttttntgcgcgggaannagaggcggagganccacgnnnacngggccgaaancanggcccnngtcnataangncgcnnannancgcgcnggangggcgnncnngnaagatgancggnnangcgcnnaganangaggcnannnnggcngggcaagcnnnnannggnagcagngtgngnaganaangnccgaggcngnngnncgananngnggantcgggagncannggnnangagngaganacaaaanggnaatgggcgnannnncgnggngnncgnnnagcnanggangccngagnncgggngacanncagcaagagncacnncnganggnagacntccngcncgnagggaaagccnanaanangcgcgnctggcnnangcggnggnngnaagagngnagnncgnnngnnnnnnggngggtgcgacgacgaggncnnggcagnaggcaaggcanggcgcgggnnnnagaggnaaagcgcgnaancacgnngnggagngnnggnanggatagcggngaaanacgacggnanggggacagnagnngaggnagcgnagcggcnanacgcgnnngcggacnangcggnanganngnanggcacgngggaangnggnggnagagagngggaangnggngnangnngcngcnnagaggggacacgngggnggggggagnaaagnngnnggaggancgnggnnatngnaatnanngggnannaacgggnanangggngcgangcnnannncaagggangngcgancgganggggnanacgctaaaagcgnaaagtgganngaggggaanngcggatannnngnantnntangagaaganaagcgancgagggntggcgngcgaaanananacgggaggannacaaagcgnncangggggggcncgagnggggngggacngggnnnngaagggggggacggnccnnnaggggcgcncgangnggcanaaaatgaagagggnggggagggnggacntggtctgnggcgaagaaaagnggcnggcacgnaggacaagaaanngggggggnnggganaanangacagggngggggggaaggtngaaaanggnggaanaaggggaganannnncccnggggnncgtaannagnannannnngc

SEQ ID NO: 1861 - DNA, 756 bp, Homo sapiens
  misc_feature (1)...(756): n = A,T,C or G
ngtcnnnancccttccgcagcgcagacggaaccgcgatggtggcacctttattagtgatgcagacgacgtcgtgagtgccatgatcgtcangatgaatgaagctgctgaggaagacagacagttgaacaatcaaaaaaagccagcactgaaaaaattaactttactgcctgctgtagttatgcaccttaagaagcaggaccttaaagaaacattcattgacagtggtgtgatgtctgccatcaaagaatggctctcacctctaccagataggagtttgcctgcactcaagatccgggaggagctgctgaagatcctgcaagagctgcctagtgtgagccaggagaccctgaagcatagtgggattggacgagcagtgatgtatctctataaacaccccaaggagtcaaggtctaacaaggacatggcagggaaattaatcaatgagtggtctaggcctatatttggtcttacctcaaactacaaaggaatgacaagagaagaaagggagcagagagatctagaacagatgcctcaacgacgaagaatgaacagcactggtggtcagacacccagaagaagacctggaaaaggtgctgacagggagaagagaaggctcttagacctgggagatnctggatttgtgccccgtgccaagggtcccaatgccttcaaacaaggactatgttntcaggcccaatggaatgtggaaatggagtcatccaggtttcagcgacctccaaaaaggtatcaatccn

SEQ ID NO: 1862 - DNA, 778 bp, Homo sapiens
  misc_feature (1)...(778): n = A,T,C or G
tnacantgaactctttggaaanccccngctgncgggaagctcgatgtcccaatattggagagtgttggggaggtggagaatatgccaccgttttnccacgatcatgttgatgggtgacacatgtacaanaggttgcagattttgttctgttnatactgcaagaaatcctcctccactggatgccagtgagccctacaatactgcaaaggcaattgcagagtggggtctggattatgttgtcctgacatctgtggatcgagatgatatgcctgatgggggagctgaacacattgcaaagaccgtatcatatttaaaggaaaggaatccaaaaatccttgtggagtgtctttactcctgattttcgaggtgatctcaaagcaatagaaaaagttgctctgtcagggattagatgtgtatgcacataatgtagaaacaagtcccggaattacagagtaaggttcgtgatcctcnggccaattttgatcagtccctacgtgtactgaaacatgccaagaaggtcagcctgatgttatttctnaaacatctataatggtgggtttaagcgaagaatgatgaagcaagtatatgcaacaatgaaaagccccttcgtgaggcagatgtagactgctttgacttttaggacaatatattgcagcccacaaggcgtcacctttaangntggaagnaatattattacctccctgaaaaantncaaatactggggaaaaaagtagggaaatggaccttggaattcaattataactgcaaagtggnccct

SEQ ID NO: 1863 - DNA, 1574 bp, Homo sapiens
  misc_feature (1)...(1574): n = A,T,C or G
cngaacnacggngnacannggggnnnngccnnnaaggggnagaaggggngaaannnnnannggggnnnnngggnnnnaannggangnnngggaaanccgannanggcngnnangncnaangnnagcggngncaagncngnancgggaccnggannngcnnggngggnannncaangcggaacggnnangcgannnggngnngcnaangggananggnnngcagcacgacacagaagnnanngcaaggannnnnnnncnnnnngnnntcgggaatnccggaaanccccttttgggngaanngnaccgcacgcaaganacgcagggacggggacncnccnacngactnggngacgccggncngctccnacgngcacngcangncggnacngangnagacaccanngcacgaangaanggcgccgggcaggngagnggnctggcgggggcngcgaagacnggnggncccacanngaagcagggngcnatgaccgancctnangcaggcgcncgaangggaccntcgacncgcatgnnggagnaaggagggnagacgagaancgtacccngcaggnaagantgcagggnggnggncgcngcaggcgncntggggcgncnggcncangngcgancannngnctcgncagaaggagnagcccgnaccnanatngngagacgccnangccacgnaggcncnncgngnangaggnangcnncanccnaggcncaaaggggacncgggcgcagagncggacaccacgaggangggcnaganggnnggggngcanggaagnccggngatgcgncgagngggaangagnngnccagggaggncgacnanggccncnnngngcgngggcncagaacannctacgangaancggngnncgaggggcncacagnngtgcccgncatggngggcagnaaaggccgagcgnccgnaggcancgcggngcncanantagganaggggcngcatctaaggggcncacaanaaagggnngngaagcgncaggnacnaangggnggncagggnacgngggcccccgnccgaaaccanacgnnagcnaacnngggggcganacgccgaggngggcananacggcgccccnancgaggagggtcncccacnngnggggnaacgcncagangngagcangntaaacacngcgggagcgaanngggggnnncacagcgaacgncgtcgntntangcgggaggggggaagggnaggaaaaanncaanncncncgagngngaaancnacgggganggcaancntangcgncnngnaccnccctcgggnggtcggggggagccncacgggggngcagcaacgnganaaaantantaacgtacnnanggaaagggggnggcngcngccgnancgaatngacangggncanacgngaaggngacngaaggggggggngnggcgacannaaaggggncangacgggacngnnggggnggggggacggacgncacgngncgcnnntgcnggggggncgganngcggngaagggangcgnnnccnggacgnaaacnaacgcnngngagcgcacgcggggnagagcg

SEQ ID NO: 1864 - DNA, 747 bp, Homo sapiens
  misc_feature (1)...(747): n = A,T,C or G
tnttgtaccccctntcganttccgttgctgtcggcctcggccccagcagccacagcaggaggaggtgacatcacctgtcgtgcccccctctgtcaagactccgacacctgaaccagctgaggtggagactcgcaaggtggtgctgatgcagtgcaacattgagtcggtggaggagggagtcaaacaccacctgacacttctgctgaagttggaggacaaactgaaccggcacctgagctgtgacctgatgccaaatgagaatatccccgagttggcggctgagctggtgcagctgggcttcattagtgaggctgaccagagccggttgacttctctgctagaagagaccttgaacaagttcaattttgccaggaacagtaccctcaactcagccgctgtcaccgtctcctcttagagctcactcgggccaggccctgatctgcgctgtggctgtccctggacgtgctgcagccctcctgtcccttccccccagtcagtattaccctgtgaagccccttccctcctttattattcaggagggctgggggggctccctggttctgagcatcatcctttcccctccctctnttcttccctctgcactttgtttacttgttttgcacagacgtgggcctgggccttctaacagccgncttctanttnggggctagtcgctgatctgccggttccgccacctgtgtngnaangaggccacnggcactangggaaccgaattctacaatcccg

SEQ ID NO: 1865 - DNA, 858 bp, Homo sapiens
  misc_feature (1)...(858): n = A,T,C or G
atttctnaaaccccttttcgantccgttgctgtcggatatggcaatgcncctgccccggctnaaccaccggcggtgcncgccagctgtanggttttccnctcccagtngcctgcaggtgncnacaagaaagaaggcncaggncgctcaaaacagntaaccagccttcacttgaggactggtgtgaaggtgcttgntactgggggaagtgantctgagggaggggccttaccacaagttaccttggaatttgggaatgatcccaaantnccaaagacgtanaactnggattgctcggnttccaaaactccgctgcaggaatgcttgtcctggtgctgcccatctngccttctgggctgcgtctttctgcctactacatctgtgttgcagatgaggatgaatacanggantttttcnacctngatcatgcccacacccttcttgangggactatcaaccagaaangaaaggcattggccatgggatcaatttgcttttnccaaaagcctttccttaatggatgggntgaatgnaaaaaatattgaagaaagaaccatttatttaaaaaagtgggaagaatcaaaaaccntttttacaaaatttcattggaaanccgnaaatttgcttggctttggtncanggaancccanantttttgganggttatttccctnggagtnggganaagnccccctctttttttgaaccttgncctttacaatttnaaaaaagtcaaccggagccttccccaaccctngcaacccaagttgtngggaagggcccaaaaggattttttggangtttcaancnttntgcccaccccctgggtcaacattggttcaaanaaatggcttaatttt

SEQ ID NO: 1866 - DNA, 1298 bp, Homo sapiens
  misc_feature (1)...(1298): n = A,T,C or G
cnccnncaccnnnnnnnngnnnnnnnnnnnnnngannaaannnnnannnngnaanngcnnnngnnnnaannnnnanngcaannnnnnannngnnnnnncnnnnnnnaannnangangcgannngcnnanngannncggangcgnnnacnnccnanannnnanngnnacnnnannnnagnngannnacnngnnannnangaagngangnaacnnnnnnnnnnnnnnnntagaaacggaaaccccnttggcgaaagnccngngganggncgagcncgnccnngcggggnnngccngaggaaccnggnngnccggcnggaaagcggggggcgggggggcatnggcaaancgaaaaggcgggaccggggccgggggggggccaggncctagacggccaaagcccggggaggggggccccaangaaangcgnaccccggggccncanccgancccaaaaaaagggannnngggggcgnaggaccccagganaaaaaaaaaaggnngtnaagaanccggnaaanttnnggaaaaanaaaaagccnggnccanggggnaaannnntccttntccanggggcaagccngggagaangaancagnnaggcccngggggaacaaggancccccgacctggnnccgaaaantnttncggcctnaccanggggcgaacnaaaaanaaaggggcccggggngccanccccnaagcccnaaaaggaggaagnggggggganacccgggaaccnggnaccccnccccagggaaggggcccaagngnnagggccgangaannaagtnaanccagnaaggnnnnaaaaaaggaaaaaatnncccaccanaaaagggantanangggananggccacgccccaaaanggaaaaaaaggggggccatgggggnnccccnnggganngacccaaaaacnnnccnaaaganaaaggggggggaaannaccgnggacnccaaangggnnacccccccaaaacccaaagggntcttcccnccccaagggaaccagggcccaaaaaaanggggggtnggggggaaaaaantnggggaaaaaccggnaaagaaaccanatcnagggcgcanaaaagggaaaaggaaangaaaagcccnntatnccaaccctntgggggacnagnggataaagggnacccccggganaaanaggggggaanaactngganggaaatnaanaaggggaacaaagaagnaaagggcccngnacgggaattaanggggcccgccaacaanaannaanggganccanagccagnaaaggccngncanaaaaaaaaang

SEQ ID NO: 1867 - DNA, 755 bp, Homo sapiens
  misc_feature (1)...(755): n = A,T,C or G
tactgaccccttgcgantccgtgctgtcgccaaacaaacattgcagggttgatcctagtcttgaaagttcgggcctttcctcttggcctgtttctggaggaaatgctcatgaggtgggtgagaggcggatgacatcctgtcgctctggcctcaccctggggatgccacatgacagcaccgcagcattttcaataggtgacccacctgcgaggaggaaggaaaaatgtgcccaaggccattatggagaacaaacacctatgcagttggagaatgctgaagacacccaagggtgttgtcctctccctcctgagagaagctaagaagatccaggcttagagtgctacagaaatagagatttaggatagaaaaaaaggaaggatttcctaactaccaccagggctatgaggcactgatatgacttacttgtgaacacagttgtatagaattgttatgtggcaaagacgaaagatcacgctggaatgtcttttcacgtatcccttggtggcagcagtgggcagcataaaagtacaagatggcaggtggaatctttaaccttgtggtctggangccgcatgatagggttgcagtgtattttccttctctacangcttgggccctcattctgttttctcacattcctccatcctantattctttgaatcctgtctncctncccttgagatctggctctaacttaagcccaatattcagaccaactttaccttgtctttttnaccaatcacaggccgantttt

SEQ ID NO: 1868 - DNA, 758 bp, Homo sapiens
  misc_feature (1)...(758): n = A,T,C or G
tnttngaancccttttcgaattccgttgctgtcgggtttctcttgaattattttggaacaatgccaggatccaaactgattaagttacagtttaagcacccttcagtattaatatatacggtattatataacaggtcaacaagtgctctttgatgataaaacttgtaatagagcaataattgtaaatggttaccatactgtaagatattttgataaaaattaactagtaatacttgtatttatttgaaacactgggctgtttgcacagctccaactgtgcatgctcaaaatgtgcactttttaaaattgttacttttaatgcgtatctttatatgggatctgttatagtatactagggcatgatatggtatccttttgagtgaggtatatactcatctcacaagtgaagtgcctactgatattactaaagtacattatgtttactcaagtaaataattttctccccatggtacactctagtgtaggctattcataccacactgaaatgaacaactgaagaataaggctaagaaccaataaaatatttctctaattgctagtgtaaaactgtatccaaatttcagaaaagacagcttcagcttgcaaattctatcctctaaacttatctgggcattcttcccccccacccccattatataagggctattttagatgctttaaccctccccacaaataatttggccaggtgttccaatgagaacttatcatgttnggtggtgttaaggnaaatcgggcnt

SEQ ID NO: 1869 - DNA, 764 bp, Homo sapiens
  misc_feature (1)...(764): n = A,T,C or G
ntatctttagaccttngtgctgtcgcctaaactcggagcagtgggaccctgaagatgtggaacctcgaaggcagcaaagaaaatntnggancctnttgggatcccgggtgnccccaggntttgggggggccagncccnctggntggngangantaanaccttctggancccagntcancancttaaaacccanggtcagggnttcgttcaataacgccagcgggaatcaatctgcactggcaccgcggcaggaactgaaactgcctggcaagtgaggaaccaggagccgcactgagtgtggctgggctacatcatagctcatcacggagctacgactttgggtactgcggacagacctggataggcccagcattcgttctgaagatcacagttcacagaagtttttgcttcgtaaagataatccaaaggatctcagaccccgctcttccttttcccttcattcccttgagagtcagccatgaacggaatacctgctaggttccaggaatgagctcacctaacagatagcaaatgtgtctggttagatctcaacagagcccattctgcaagacctggctgaccagatganagggtgggccctgtgctggggggccttgggtcacacacangaaccgagacctggcttccacccccagtcacccactttgggntatcttgctgggaagttatcgatanggactgtgtnggccaaccaagtgctttgggaagatcactggcacttgcaaaacnaaacaaaattgctt

SEQ ID NO: 1870 - DNA, 750 bp, Homo sapiens
  misc_feature (1)...(750): n = A,T,C or G
ngnntgtaagccttngggctgtcggtaggattataaatgggtttaaaatacgtattctcaaacctcattttcagcatataaatttttaagantnagtgttttaaaggtnccgtgaaaaccatttgctagatttttgtcctagttttttttttttaatttaaaaatcttaagttttttttagtaagcttaagancccagtagtttatttgccgaccgcatttttaaaaagngaatagatgtttaactgaagttaaatacaaatttatgtctgggtaactcttggtaagatataacaaaacctagacatctaaattttttggaaatttttattttaaaagttggtngggaggtaaaatngggngactttccttctggttaatagttttatagttaanaanaaagccagcgaagtttacttgatctcagttgcactcaagaataggggatttaagttccactttggttattttcacttctaccctaaattcataggccctgatacttaagcttacccttggcttccagttttcattgcagcgagnaaatggggagtagcanagcctttgttaatgtaaattgacaaaaaggtntgtccttttntacaggagcagataaactgataatggtnttaaaaaatgtanaaaatgatttttgtanacaggatgatctgtctanattggagcaaatgangggncatnttccaacaaaggtgggccccttcatttaataaacacccccaacaacaaaang

SEQ ID NO: 1871 - DNA, 750 bp, Homo sapiens
  misc_feature (1)...(750): n = A,T,C or G
ctancntttcgancccgtgctgtcgctggaattttctttactcctgtatctgatgtctgggctgcgatgactcaaaggctgatttcagctganactgtagaccacgtgcctacttgtggcctccccttttgccttgggtttctcacagaatgtggctggttctggagaatgagacttccaatgaaatcaggtggaaatgacatctcgccgctttcagcatgctctattggttggaacagttatggacttagctagattcaaaggaagggaacaaagaccccctcctctcagagagtggggcataatgagagaatttagggccatgttatccaaccaccacaaatgccttctgaatttgaggttctgcctcaaaagttcatagttcctttgactgaaggacttctatatatccaagcatcgtcagccccaggtatattgttccatgtaagtgaccaggactaccttagtatttcgtatagggaaagtgacctgaataaatttgagaaaagaatcttncttctctccagtaagcactgaggtaagcattgagccatattatangtttatgactttgagactcagaaatttaaattcttggccaggccaatggctcaccctgtaccccacacttttgggaggccangcagcagatcactttgagncaggagtttgaaaccacctggnccaagtggngaaactncttctntacnaaaaaaacaaaaattaccnngngtgnnggnggcccctgta

SEQ ID NO: 1872 - DNA, 758 bp, Homo sapiens
  misc_feature (1)...(758): n = A,T,C or G
tattntaccccnttcgantccttgctgtcgattcattttgtataatcatgtatcctcttgtgtgctggtagagattttaatcctgatttttccataaaacatgagtattaagaaataattcctgggtttggagaaactggagaaaatcacccttttaaggaagaaacactggaaatttctgctaacaccaagatatttaagagtgtcatagtaggtgctcaacaaatttattgaatgaatgagtgaatggaaaaactgggagagtcaaaagtgagcagaagctctccatttctacttctgtcacaaaccacattaaattgtaaataaggcccttctccacttgacttcaggcagcagattgtctagaagcctaaggacagcaatttctctgacaagacaaagtagatattttataccaggggttggcaaactactgcccacgggcccgaatttggcccagtctgtttttgtatggtgcaaactaaaaatgatttttacatttttaaagagttataaaagaaaaaaatatgtggtctgtgaaatctaaaatatttactacctggcctgttggaggaaangtttgccaatctctggtttataccattaactatgagattaaccaaaaacttttacctttgtgcagaaaggtnaaaaaaaaaacatggttaaggnaaagganacatgttacctttcatacactccttttaactgngggatttgcaaaaaaataaaaatancccctttnaaaaaaaaaaaat

SEQ ID NO: 1873 - DNA, 758 bp, Homo sapiens
  misc_feature (1)...(758): n = A,T,C or G
ttntnttanccctttcgantccgtgctnncgcangaatgnngttcctcttggnancncccgggtggncngtttnttnttnngcccnggttccggcccggggcccctnggggngtttacntcaattgggggnttnaaaanggcntnttgtaangggaaacctttnnntgaaatnntncaggaaaggaaccnatgggangggaccaggaggggaannccgnnntaaaccncttaaaaanttttgttgaccgggtttccanncggaattcctttggggagggggngctggngaaaatnctgcttgggagatcncattaggganctccccgttttgaagaagaagactcantgggaagacanangaagaagaagatgaattcttttggccctcaaaacccccccaccaaatggtctttggnnaagaaaanagtttcntcncacaaaatatgaaaacnanggaaaggaaaaaatggatgcnttgcttagaggtgaaaagaaagagagcnccgaaccgttnggaacgacntttgngaanaacaggatanaacctccccgggantgggaaaagacaggaagaaangggaaatggcaagggagcattccangaaanaaanggacccttggacnattaaaaangaactggagcgggacccangatcccggagcacacaaggaccacgggacnaaagaccctaccgccggccgangaccgccaggacggaggccccaggaatgtttgcntaccnacgtgagagggctc

SEQ ID NO: 1874 - DNA, 1001 bp, Homo sapiens
  misc_feature (1)...(1001): n = A,T,C or G
cgccngacnngnncgannannnnncnnnnnnnnngngangannnccacgnngnannnanacnaggngncgncggcgnacnncnagnagacgacncannnnacnannnnnnnnnnnnggaannaccgnngcnatccngaancgnngnngacgcanccgaccccaccggcccggnnccaangngagcgggnagcnggcngtttnnganngccgcaccccaagaaaacaggggcagnccgacagacccanagggnnccacangagangggacnnggggccacagagccggacaagaccngnagnacacagaggggaggggaggaacgacgacaacaggccaggcggccaangacnggggnccnggcnacacaccagngcacccngacncnngaaaagcccnngcngaacccccncgaaagngggggagacacancccgggnnaaaanggcnacagacnccncnggggacagaagnagagagcggnaaacngggagggagnnggnaggcanngcacaggngaaggganagcccgaacgccctaggggcgnnacaggcgancacagnaannanggnagcnggggagagccnggnacacacacanacccgngaaacnggggcgnagagaccngcggcagcacgcangacccggcnnggnaagaanccnggacagnggcngnngaacnaaganannacnngggnnnagncnacccccnnancngacncgngggccaganacccncaacccccggagggncagnangggncnaaccangancgnaggggnggcgngcgcaccaaagacanccccgggncnngnnggagnnacaggngaccnggagnnagccggcncggccnggggagagaaacncaaagncggagncanccgcnnacgcccggnagncangacaacggagagcggngngaggggaggcaagcgaccggacggcancccccngggagcngggannngncacncggggnnnnnagcgaaccngcccacccg

SEQ ID NO: 1875 - DNA, 1447 bp, Homo sapiens
  misc_feature (1)...(1447): n = A,T,C or G
cccccccnncnnccgnccaccanccacgngaanannnnnanngccgngnnncgnncangnggncggccacgngcacnngaacgnacacncnncncgnnnnnnncccgncgttngaacncatcganccncnnggcccccgagnccccacggnccccatgggccnggggggcagnggggggggggggggngttttnnncnnttccnnccncnagcgacngngggggannnggggaangnctnnggncncgctnntcncccccacnncnaccagagggagcgtnacnncgcncgngaggggcgngnngcccncggcnccgnnagcnccctncntcncnacccnggcngcggcgagggncgngcatcagatnnnngnanncncngngnngccnccngcgcncnngctgcntcgccnagcancggcnagacggacngagcggnncncagccancnacgncggtccgnancgcntntnnngtncgtcgncgtncggccgncgcacgagccgannctcgcgcactgnccncgngcgncgtnncggncgntgtcnncacgntcngntggcangnncggnacgcgnancggccgnacgcgatgaatgngcgcgcnggcgnnntccggcnncgcgcgcngcaggngnggcntnnnanngggnacnnanngncncngtgcgcgagnncncgaccagactcncggccnacgnnacgcncgcngngggngacacgtgctgcatgngnancggcgcggnangnggatgggcnngnncgnganacgcatacgccncggtanngcgntcgcgtnacncgaccgntagngtcgccnctcgcggagngangccggcgcnanggtacngaaaccgcacgcanacnnncgancncngtncncacgggcgccagncgacgcacgncnccgcgagnnaacgncggancggngntcngngnngctcntcncgcacngacgcgntncgngnanacggcgcgnnnntncncncnggaggcangnngcccgacggatctgnncgnncanacgngcgggngncacgcngncaccncacccgcgcacngncggcacgcgcgctcggnngcgnncgnagtgaccacgatncgacgcgnncggtcgcgnactcncgnaatgcagacgtgcncgaacgcaaacngcgcgnacgnncnggcagaggacgncgtaacggagacgngtngcgaacgaccgcgcacgngnagnnctncgcacggctacgnngctgcgnacgngnaagngnnagcgggnnngcncncgtgatccnncncgggatcgcnannncacacgtangcnagcgntggcgccacgcgcncgcgatcacgnnnnnnacgcgcggggacnggnggagcgnngncataggaaacncgcanccgactagnaatnngctncncgcatngntngccgctagggcangcnannccanacgngtgcc

SEQ ID NO: 1876 - DNA, 735 bp, Homo sapiens
  misc_feature (1)...(735): n = A,T,C or G
atnncgttcaactacttgttctttttgcaggatcccatcgattcnaattccgttgctgtcgcantgagcgggtctgggcggntgctggcagcgccatggagacggtacagctgaggaacccgccgcgccggcagctgaaaaagttggatgaagatagtttaaccaaacaaccagaagaagtatttgatgtcttagagaaacttggagaaggattactgtagatgcagtatatggaatcaggaatcttaacttcatgtgagctattggagttttccttgctatcaggatgcatagggaggtcctatggcagcgtatacaaagctattcataaagagaccggccagattgttgctattaagcaagttcctgtggaatcagacctccaggagataatcaaagaaatctctataatgcancaatgtgacagccctcatgtagtcaaatattatggcagttattttaagaacacagacttatggatcgttatggagtactgtggggctggttctgtatctgatatcattcgattaccaaataaaacgttaacagaagatgaaatagctacaatattacaatcaactcttaagggacttgaataccttcattttatgagaaaaatcaccgagatatcaaggcaggaaatattttgcttaatacagaaggacatgcnaaacttgcanattttggggtagcangtcaacttacagatccatggncaagcggaatacatgatag

SEQ ID NO: 1877 - DNA, 735 bp, Homo sapiens
  misc_feature (1)...(735): n = A,T,C or G
annccttatncngatcagctcttgttctttttgcaggatcccatcgattcgaattccgttgctgtcggtggaggggccgttcnaagagtcgtgagggggtgacgggttaagattcggagagagaggtgctagtggctggacttgacctggaaagaatcttctgctgactctcaacttttcctggaaaaaatggatcattcccaccatatggggatgagctatatggactccaacagtaccatgcaaccttctcaccatcacccaaccacttcagcctcacactcccatggtggaggagacagcagcatgatgatgatgcctatgaccttctactttggctttaagaatgtggaactactgttttccggtttggtgatcaatacagctggagaaatggctggagcttttgtggcagtgtttttactagcaatgntctatgaaggactcaagatagcccgagagagcctgctgcgtaagtcacaagtcagcattcgctacaattccatgcctgtcccaggaccaaatggaaccattcttatggagacacacaaaactgttgggcaacagatgctgagctttcctcacctcctgcaaacagtgctgcacatnatccaggtggncataagctacttcctcatgctcatcttcatgacctacaacgggtacctctgcattgcagtagccacaaggggcccggtacaggatactttctcttcactggaaagaaggcagtgg

SEQ ID NO: 1878 - DNA, 978 bp, Homo sapiens
  misc_feature (1)...(978): n = A,T,C or G
ggacctntgctcttgttctttttgcaggatcccatcgattcgaattccgttgctgtcggtnntgtnagatcactgggatattttccacaacttcctctnntctagcacacacatntgttgntnggaaatatttgagggtttttccnctaccaaatgggagcttcatggtcctggtgtcaaacactataaccttgaccactgactntgatgntggcacatatctgagtcctgtgtgcacagtaatattctgggtcaaggaaaatccangtctttcaagttttaaanggatttttgganaaattcgggccttctttttaagaccgaatnccattggccccaaatttncacaaaggctttgggtggaacaagttgggaattaaccaaanttttggtggttggggccaaaaaagtttncccaaagggtttggnttaaccaaccttgggnggcccntttttaaaaaaanccaaaaaaaanccttttaaaanccctgggccatttggggaaaattngggttttnaaacccttttaaggnaaggaancccccnttgggaaagaaatnccttaaatttttnaattccaaaggggaancccccgggggaaaaggnaanttcccacccaacctttttcaaaggggtcccccattttggccanaccctgggaccttttttttggtccntttgggngngaatccnttcaaaaaccccttgggtttgggaagccccctgggggaaaagggggggcccnttccaaccaantttcttggtgggccttttggaatanttaagccccccaantttcttnnaccaagccnccnttaccaaaggccccccattnaatttggncccncanggaaaaacccccnnggaatggggaaaaaattgcccagttancccccatgccactggaanaccttaanaaaaatcgttccttactnnggngaaaaangtattatggatgccantaaagngcccactggg

SEQ ID NO: 1879 - DNA, 694 bp, Homo sapiens
  misc_feature (1)...(694): n = A,T,C or G
attcgntacaagctcttgttctttttgcaggatcccatcgattcgaattccgttgctgtcgatgtgtctctggtacagaatagttgatattaacagaaaaaaaaaaatctgtagcttcatgaatatgccactctgttaatttcttgttccagacattttaatagagattgcttgaccatgttgtttgaattgctgccaatagcagaccatatccctatcatgttgttggctcaactgtttttttttttccctaatananatggagtatcgctgtgttgctcaagctggcttgaactcctgggctcaagctatccttctgcctcggcctccaaagtactgggattataggtgtgagctactgtcccaccttaacctgtttcacagtgaatatacttcatgctggtttcaacatgggattattaaaggattaaaagttngggtggatgcctgtaatccnacatttttggaagcccagggggcggtcaccaggcangaaatcnaaacattggactaccaangnaacccnctttataaaataccnaaaaataacccgcgtggngggggcgcctttattccccttctttggaacttaggcnggaaangggtgnanccctnagcccaaaangncnttgcttcanctngggaaaaaaggantttttntaaaaaaaaaaaaatngggggaaaaaaattngan

SEQ ID NO: 1880 - DNA, 711 bp, Homo sapiens
  misc_feature (1)...(711): n = A,T,C or G
nnngnttnnnnnnngncnntttgatnccatacnncgaatngatanacanctacttgttctttttgcagancccatcgatcgaattccgttgctgtcgggggaaaggtacntnaaaccatnngctntatgttagngactaggagngattganananccctggagattgntnanatganctncagngccnacggcccattctttnatagttggtnctgtgnnggagaggnncaggctgtgagcctccaaacannatttnagaccnantgganngagncntnnnactggacnggtnnnatanccnnngtgnagganngngcnaantcactngnacggctannatggcnagngnacgacancagttccnnngntngcgcantngcntacccggnaatcctancgttttgncgacngaggcnaaggangnttgcccnagngtnnaaccagcgctgagaantacngtgaacccctgnntctgaaaggcaganggtnacngggtggggngaccncccctagacgntnntantctaaggctgggagnnaagattgtttnatcccggaatgttgatgcnnantggancannaattnncccnatggnnncnaatctnngcgaanaaaaaggggaannttggcngaaaaannnanctaatgggtgnaaaaaangnggntgantnaacaaaaaaattnaacgcgaaantttancagnncgttt

SEQ ID NO: 1881 - DNA, 672 bp, Homo sapiens
  misc_feature (1)...(672): n = A,T,C or G
ngnnnnnnnnnaatananatanacaanctacttgttctttttgcaggatcccatcgattcgaattccgttgctgtcggcggcaaattgtggaacagatggaaaagaaccaggaggagcgatcgctgcttgctgagcagcgggagcaggagaaggagcagatgctggaatatatggaacagctccaagaggaagatctaaaggacatggaacgaaggcagcaacaaaaactgaagatgcaagctgagattaagcgcatcaatgatgaaaaccagaaacagaaagcagaactcctggctcaggagaagctggcagaccagatggtgatggagtttaccaagaagaagatggctcgagaagcagagtttgaggctgagcaggagagaatccggagggagaaagagaaggagatcgcacgcttgagggccatgcaggagaaggcccaggattaccaggcagaacaggatgccttgcgggccaagcgcaaccaggaggttgcagacagagagtggcgcagaaaggaaaaggaaaatgcgcggaagaagatggaaacagagctgagctcgaaaaagtcgctcgacagtggcttcaaggacacgctctgctgtcagtgcacggccggtgattcagagatcttcgctnnaaacaatgaaagcggtgagaggaaagccagg

SEQ ID NO: 1882 - DNA, 718 bp, Homo sapiens
  misc_feature (1)...(718): n = A,T,C or G
nnaccncgagcgaattccgtgctgtcgagaaatntgaaatgcttaatttataagcgggctggagattttttccaatattgttttctttgaaaatgaaaggggatcatctattttagttttggggtctgggaactttttgaaaatttaatttgtggaccaatgttttgtgaaagctaaagagggcaggggttaaaatagggcttgaatttctcattctgtatagaccagcaaacttccctgtgcaaggcaagtttacatcacaaatccaagaatgtttgcatcctaaatgctagtttgcttcagcccctagttaacctcaggacttggtttgcatataaaaggtagacagctgatatgttttcatgaataaatattgtcagccagaaaaggttggtgtcaggtaatgcatatttttttaagctttgttttatatttatttttcatttagtttttattgggaatggttttcaaagaactctcagttctgcctaggtgtttttgggggagccctgttttccatagtgtaattccatttaagaggttgtctaaaagtctttttaattaatagaaagattttaatatccaagagtagtcaaattaanggatataaactttcccccctttctgtccgtgacagataaaaagccacagaaagggacaaccccttgaaaatcatgtaaccgttggtccatttcaataatttggtaccttgttttaa

SEQ ID NO: 1883 - DNA, 712 bp, Homo sapiens
  misc_feature (1)...(712): n = A,T,C or G
aattccgttgctgtcganaccaagtgctctacanggcnacctgtgagcccagactggatcctggaccagaaaaaggacactagtgagacaactggcagaatttgcataagaagcacggcctcggcctcgggtggtggagtcactgctgagcccatgacgttctgcttatattccatccctgcatttggaagtcgttctttgccaggaggaaagtgaggaaaaaccagcaataacaaaacagcagctctactgacggaggaggaggagcccaggaggcggctggtcagggcccaggtgtggagggaggccaggcataggcaccccgacttctctggaactactgacattttctcgcaagcagagaggaagatggaaaggtcagggaggagaatgagggaggggtctgccgcggggagccacaaactccgtggggcacagaaagtgcaaccgtctcccattgaggaaattctccccaccgggcggcttgcctctaaacaggatattgcttcgatttctttgatttcccttctctctctctctctctctctctcgcaaaaaaagtcttgattctaataacngcttagaatatttaaaataataatggtttnaatggtattgggttctttgtttcccacccaaagnttcttnttcttntttctttttggccaataaaatttgnaaaaattgnggaccttcaacttttgttcttgtc

SEQ ID NO: 1884 - DNA, 661 bp, Homo sapiens
  misc_feature (1)...(661): n = A,T,C or G
nctcgntcgcctaggccccntggacctggtctttcagacacatntagccgtgtttccccatctgctgcccgtgatccctatgatcagtctccaatgactccaagatctcagtctgactcttttggaacaagtnaaactgcccatgatgttgctgatcagccaaggcctggatcagaggggagcttctgtgcatcttcaaactctccaatgcactcccaaggccagcagttctctggtgtctcccaacttcctggacctgtgccaacttcaggagtaactgatacacagaatactgtaaatatggcccaagcagatacagagaaattgagacagcggcagaagttacgtgaaatcattctccagcagcaacagcagaagaagattgcaggtcgacaggagaaggggtcacaggactcacccgcagtgcctcatccagggcctcttcaacactggcaaccagagaatgttaaccaggctttcaccagacccccacctccctatcctgggaacattaggtctcctgttgcccctcctttaggacctagatatgctgttttcccaaaagatcagcgtgggaccctatcctcttgatgttgctagtatggggatgagacctcatggatttagattggatttccagggaggtagtcatggtaccatg

SEQ ID NO: 1885 - DNA, 661 bp, Homo sapiens
  misc_feature (1)...(661): n = A,T,C or G
gggggncggctgagacacataagtacagaatcatgaccttaatggtttgacagtttggaagcaccctggcaacaagccatttcagtggaatggtagaaatggaaaccacgctgggttgagaagtgagtggatgtgaaaatatggggcctctgaatggaggtaacccttgaaaaattccactgtggagaagaaaggagagagagagggctggaatttggaatgaaaggagatatttgggattattttagtaagaaaacagaggtgtcatgacctcagtgtaaccctattagctgcaaaaaattcttcatgggcttgagatggagttagccatattcattattgaaaactatgttctgcacttatacattgttggttggagtgtaaattagttcaaccgctgtggaagacagggtgggtgtttcctcaaaaacctaaagacagaaataccatttgacccagcaatcccataactgggtatgtacccaaaggaatataaattgttctactataaaaacacatgcacacacatgttcactgcaacactatttacaatagcaaagacactggatcagtctaaatgcccatcattgatagaatggataaagaaaatgtggtagaggtacaccatggaatactatgcaccataaaaaagaatgagann

SEQ ID NO: 1886 - DNA, 1009 bp, Homo sapiens
  misc_feature (1)...(1009): n = A,T,C or G
anngnnagaatttaaanntnaattggnatatnnagngntgggggggggattntnntanactatnnntnttatttntnangaaatnnnnttaggtanntannantnantntnnagtntnggggggnnnntnannanatgnnnatntttttggnnnngantggannccgaaanaatggatncaattnggggngaaaatatatatatntattngtnagagagnattangcnnntanttattntatnntaattntaaantaactagnntnttagngtgcacnattntcntanngnatnnagannatcggtattatacacaantnactaatatnncgttntngttataantgntcatattagattaatncatacattatnantncactgtannnntttattataganagnnntatancnatttnntnattnntgattatttatannntnatnataantcttaantnattttannatatntattgnaatnctgttataaaacgnanatgnattgatagtnnnctttnaatnaaaanaaantntctcannntgttaaaaanatanatntnnacnanattttgattntnnttancnagtttcaancncnaagngnacnttncnnntnntntacnagntgatngnataatnagtgaaanaancttaatngatnatgntnannatcntnaatataataannattantntataaaantnaataanattttttnntaanatgactnannannaatnnannnganagcntnnantntataatntatttttaatantgatacatgntntnagantanntnncnttttantncttntaataactntgaaanangatctgaatacnacattagcangacattgtanntacntatacttaaacnatttatatcncgncngattatagnttatatnnntnnatnataatgtatantnntttatatatatataanannntntcatattactgttgatatgtctatnatttnntgagtatanttatagn

SEQ ID NO: 1887 - DNA, 1035 bp, Homo sapiens
  misc_feature (1)...(1035): n = A,T,C or G
atgnccagtatnntagnngggnttnttcnanttttcnnaaancncnntnnantagntatnnggggctaanngcnggttcannacngnngcangntgnnncntcggggatcattaagncnttgcttacntccacctataatcttacnntctcncnananntagnnatatattcactagnanagtntanntattantccgtgnaaatntanattctntctctnnnncnngngancgttnaggancgtttggatnctcttacatnntcctcggganatattcannagnagtcnctnagannntgnctaagtnantnaacgacatgacactntcattctcgtnaatngatatgtcnnatgnanaanaacntttttcnncttccatcgatatnnccttatntncnncnatatgtagtctntntncncgtntttacanananttnnngaatannttgggttctgtaatctntnncatctnnatgacnattcccntannctaacatatnntcgntntangnngcanagtattatanttnttanangncnctctacttcacnnattatnncgtgtnntantatanncatnttnctttagtnattcacntngannntgattcntcatctattcatncntactnngnnttctntanacttattntgcntnttatnnngnntacnnnnaattccngnattcgntaatnatggancctnntnatacnttcnntgnantntgancaatgtnannatcnnganntntcctgcgnattntanntnnctnnttatacnnngtcgattattntagntcntnnncnacntacttnntcattnatatctgtctncattgantcannantnancnantnatnnaatttnntnntatactatntctnngttntnntaantnnnntnntnntcntcnntanntactnggnntnangntatataatatanattngcatnnattncatgaatgntnntaangtnnatcnacnannanangatnctnantctntgagatnntctnctnantcganccncn

SEQ ID NO: 1888 - DNA, 867 bp, Homo sapiens
  misc_feature (1)...(867): n = A,T,C or G
tgttntntnntntnantagcggggtntatntttnttntangnnnttaanctnnattagnngggncntgttgcatttnnangggggngancttnactggntnagaanngntgngngntatancttttatctgtatnnnanaagagggggaaaacttggagntctctccntggtaantnatgcantaaggctnatggcttanatatagcttaccngttacntnattnncgtntactnnatcnttnnntntgttctacctnanttggagcttnttgngaannggggcatgacnctnnacnagtggntgggannctgtncacggtngttggatgcanaacatatactgnattgnnnncctntntagcatacnctttaanttcnataatcnagtgcnnganctntaatnactccntgcctcaangtaatctntgttntatatgtannnagtntnttttacnntaaacnttnantgcnctttatagagnagaaatcntttnananaaaanntatgnncctcatnaanannagttcattttttttaantccantntattngtggtgcggannaanagaagccnncanncnnncaaaaatgncgntctntnatntatgaagnnctatngcntncangtaaanagccttatttntacatcttnnntcctnntggctgaaccttgncannnctttnatantcatnttanggaactatgntttatngggggntcttattaggtaacnntgtttatnatnaccacatngntctntngtactcataatttnaggttnagnntcagatcacnccttanatttnggggnnnnaggnntaacngacggtcnttatantgngggagnaagnncaaactaaacnn

SEQ ID NO: 1889 - DNA, 617 bp, Homo sapiens
  misc_feature (1)...(617): n = A,T,C or G
gttgactncgntactcagcttgctgcctgcaggtcgactctagaggatccccgggtaccgagctcgaattcgccctatagtgagtcgtattacaattcactggccgtcgttttacaacgtcgtgactggggaaaaccctggcgttacccaacttaatcgccttgcagcacatccccctttcgccagctggcgtaatagcgaagaggcccgcaccgatcgcccttcccaacagttgcgcagcctgaatggcgaatggacgcgcctgtagcggcgcattaagcgcggcggtgtggtggtaccccagcgtgaccgtacacttgcagcgcctacgcccgtcttcgtttcttccttcttctcgcacgtcgccgcttcccgcaagtctaatcggggtccttaggtcgattatgcttacggactcgacccaaaaactgatagggtgatggtcacgatgggcatcgcctgnaacggtttcgccttgcgtgagcacgtcttatagtgatttgtcaatgacacatacctattcgncatcttgattataggattgcnttcgctatgtaaaatactgttacaaattaccgattacaatatacntacattctgtcgattctctacttgnn

SEQ ID NO: 1890 - DNA, 742 bp, Homo sapiens
  misc_feature (1)...(742): n = A,T,C or G
ttnattcgntctcacgcttgctgcctgngnangatccntcgnttcnaattcggcacgaggtacattgtcctgacactggaaaagacatttggaatttactttttgacctggctgccatgaattctgccagtctgatgatccacccatcattcttcaagaacagaaaacagtgctagcctctgttttttcagtgttgtctgccatctatgcctcacagactgagcaagagtatctaaagatagaaaaagtagatcttcctctaattgacagcctcattcgggtcttacaaaatatggaacagtgtcagaaaaaaccagagaactcggcagagtctaacacagaggaaactaaaaggactgatttaacccaagatgatttccacttgaaaatcttaaaggatattttatgtgaatttctttctaatatttttcaggcattaacaaaggagacggtggctcagggagtaaaggaaggccagtttgagcaaacagaagtgttcctctgcatttcaaaaccttcttcctttctatagccctgtggtggaagatttattaaaatcctacgtgaagttgataaggcgcttgctgatgacttggaaaaaaacttcccaagtttgaaggtcagacttaaaacctgaattggaattacttctgtacaagaaataaactttatttttctcctgacnaaaaaaaaaaaaaaaaactcgagcccttaaaactatagtgagtcgtattaccgtana

SEQ ID NO: 1891 - DNA, 1005 bp, Homo sapiens
  misc_feature (1)...(1005): n = A,T,C or G
tnntnannnntnancntnntanttnaaatgtaatggtnggggggncnctttantcgtnnctncnntnnatnnaacccccnngataatncnntnaaanctgcgttngggggannntcatcannatantntggnnanncncnnanncncnattntntgttactcnnagtctntnngatganaggttntcttcgagtnctccnggtnctacntgtantatnncgngannncttcangtactnntnnataatncnnnagaccatgtactcnganntnnnantccatcntggntctntccctcgcacgnagtgtntngnatcaaancgnantttgctctgaccnnngatngtactggntnttatncacanaantnacatntnttaganncttnantactnnannttggtnnngntnatctgatnnnnagananggactnntngaggattctaatggnaannaagncngcgntnnnntntgttgaannntgatnatncgntctancttnnnncantgncgaatcngcatggatggcgnnttatnnaataggctnnattgttttgngannttgcnanngttcaacnanttncancgacanttaagcatcncctannattcngtttngggnatnacatnnccatcgncngtgtnngnaccgnngaaaacngtnntttaatngttngaacntggttagntangttacnttttcntcnagnnaaaatcgncattctngcnttctaccnaatttgtanatnnaatnatcntatancatncngnctcntgtcanacttaatcngtancgtntnanncganatngatatatnnganncgntnctnnaaantnngctangantngtcntacccnctagactatatttcctctantcnntnttatncgngttaatcancgnctgtgngantgtngagtagagncatctatatcntacctcctnttgccacnatttntatcacaaatccccttntnctagcnnntgtatctacntgcncgn

SEQ ID NO: 1892 - DNA, 1159 bp, Homo sapiens
  misc_feature (1)...(1159): n = A,T,C or G
ntnntnnntngagaggnntnannntttntncnnttnttnagaggngggnannaanggttgganannagccctntntctnnncgngaantnnaatntactaagngcccggggggggggntngtggtntnttaatctttnaanatnattctttnttntntnncggaggntaacactcangaggagtgtttntntatgtngnantnttattatttnnatantgncgncgnntnnntaatanttannnanatatgtntaattctaantagnntnnattaatattatgcgntanccatctnttgnctgnntattancgtatatnttannttantntccttcnnntntatctntatgnttatntnaccatcancgnatatncngaatgatagnatgantntgtttattntctccatacgaaatgagtgntnatncncnncgatnttgtatnnnttanaatatgactgtnttntnatannactanatntatgtatgctnatgctaaactatnaatacatattgtnacnntctnttacatcgtnnaaantgttnntcacncntttgagaaggaggnananagacgtttgattntttngtgaattatatgtcgatttctgtntgttgngtgaaatnatncngttaattgananacattgnnatatntncatacngnagaataaatacgatngcgatnntnatcnatantnttatctattgtatatntncatatangnttaanntantngtntntanacctatacttnttatgtntccgtatctactnctgnttcanttnaatctagnctattntanttagtangttacganntnantncncgcttnattngtgtgcgnntncacttattntacagtatgncncatntattntngtatntntantgtnnatnattttacgntnngagtaatatgnatatanataatgnacttncacncngnanattatnnatttntttnctgnnattatattntagtttacganntantaanttntntnctactttcnttcgtaatttnangtttatgntnaganaanttcnttaatgtnngntttnaatcncataaatagtatatgcacagnntnncnatnnnnatanatgntnagntnngattnnaattnattatnanngcctngnatntaannncn

SEQ ID NO: 1893 - DNA, 662 bp, Homo sapiens
  misc_feature (1)...(662): n = A,T,C or G
nttgttcctgcctcacctcctgatagctgggattacaggcgtgcaccaccatgcctggctaatttttgtatttttagtagagatggggtttcacaatgttgcccaggttggtctcgaaccgctgaccttaagcgatccgcctgccttggcctccccaaggtgctggaattacaggcatgagccaccgcgcccggctgacttttttttttctttctttctttttgagacagagttttgctcagtctcccaggctggagtgcaatggcaacaacatggctcgctgcagcctcaatctgctgtgctcaggtattcctcctgcctcagcctcctgagtagctgggactacaggcgcatgccaccacacctggctattgtggattttaanaaattttttttgtagagacagggtcttactatgtttgcccaggttgttcttgaactcttgggctccagagagcctcccatctcagcctcccaaagtgctgagattataggcgtgagccaccacacttagcctattgngactttttagagtttctaatactttcttttagggcactaaaaacttaatcttanatccagttggttattcatttgggtgaatgaagtgntanggacctaccttaattttttccaggtttttgtgattgaataaatntcnn

SEQ ID NO: 1894 - DNA, 723 bp, Homo sapiens
  misc_feature (1)...(723): n = A,T,C or G
aggtgacctctgtgtttctataactatgttaatgtgacctgtaaaacagttcacttctcaacaagtcagcttcctcatatttaaaatgagaagttgtcttgagttttctaaagatgtttaggctgcattgtcttgggcctgctcaggattttgacctctgagataaaagctggatttaaaaagccaatccaagccaaacacctggcattattagcattgttattccatcagatctgtttgtttgataaagaagctgggggtggaattggtggtgccttaaataccctagcttggtgcagaggtaagatactctgtctgggcacggtggctnatgcctgtnatcccagcacttcgagaaccaaggcaggcaagtcgtgagtcaagagatngagaccatcctggccaacatggtgaaaccccgtctcttactaaaaattancaaaaaattaacctgnggcggtnggnggccaccccgccctnttanttcccccnatanctccnanaaggcttnaatgccanngaanaaatatnactttgnancccngggacgccnataaggnttgcnantggtnacncanaanaattcatttctcacttgggcctcccagcccctngggggccccaaagggnggaggaanttccnccctncccnnnnatnttcnggtatnaanaaaattctccntaaaaaanataaattgngcgcccaggaanntnttaaaannt

SEQ ID NO: 1895 - DNA, 1007 bp, Homo sapiens
  misc_feature (1)...(1007): n = A,T,C or G
tttctnantaanagcgggnacatngtntctttnaanctntactntatanngnggnatcttttttttccnnccnacacccnctntcctcnnaantcnannnnnngantatatcccttcannggaaaaantnaananggatgnntttatctgnnnggatcnattgnntcnncacgnaatnccncttggacaatnatcaatcggtcttntaccnntnatnttnntnnnnnnnancctagnntcgaatgtcnacctgnnantggacntctantanatcntctnannaaccntnaaactattatnactnggttacatnttntaanatattctnacnanaancattnnncatttcntctacntnattattcnaataanctcccntannnngcnntattncnanannantcattcgtaataatanattcnattntcantannntnntttcctgtnatctnntnattatntcgagtncnntatggctagcanttnnanctttnantactnaactantancantagcaaaangagacggtaatttanttctngtnacaatnaaaataaantcncgtaattnnagnacctatnnngacatctntncattcttgcntanantnnattgttntttannnnttncnanaatcnnaanattatgcctnngnactnatacnagatatantcagtatantatccgnatctnaattctggangctnnataagnatactacctnttnacgttnnatatngtatanatcccttattttanctattccatatnntcnaatccatactctntantgtnaanttaaancntaanttcanctantnttcnntananntantcncntcngctntnacttcgtnatcanattaatacntattgncttnnctcaccnaactacgctcgtatancatctatnaatntcanactnntantntatctnntatntaaannatcnnnataantnatantnatattatctttcctgtctacaaattttatcatnntncn

SEQ ID NO: 1896 - DNA, 674 bp, Homo sapiens
  misc_feature (1)...(674): n = A,T,C or G
cctnnccccaattcggcacgagaaacaactgaaggtcaaaaacttatatgcctttttatgtgtacatttaataaaacaattttattgatttcttaccgtaagttactgtgatgagtgataaatacttcactattcagatactttcgtaagagatacatttcagtggaacactttgcataaatattttctcaaaaatgtgcaatttctgggaaaaaaggaatgatggaaagaaggttattgcagttttcctagaaattttgtcagattggcatgcatttttattgactaagaatcccaattttagcatgaagaccattagatatgaatacataaggccataacatttcaaattaagcacatggagtgatttgtaattttgtgttaatttctccctaagatgttttgttaaaatgattttgtatataataaatttctaagttgaggaaggaaggtaaaaaaaattcctgataaccttttctttatgaagtctgctaataacaatacctagtatatacttagaagaaccagccaagaaaaattacctttcagcaaccactctttacttatttctcttttgnaataatacccaattttatgacccaggattccccagtttttaacggaagtaagattaaagaccaaagcccaaaaaccctctgttccttgcaatatan

SEQ ID NO: 1897 - DNA, 673 bp, Homo sapiens
  misc_feature (1)...(673): n = A,T,C or G
cccctctcgaattcggcacgagaagactttctcctaatgcttggaaaaccataactgacatagttctaaatggcacagccttcgtgacactagaaattggaaaacaactaattaaagcacagaaaggagcagcatttctttctattactactatctatgctgagactggttcaggttttgtagtaccaagtgcttctgccaaagcaggtgtggaagccatgagcaagtctcttgcagctgaatggggtaaatatggaatgcgattcaatgtgattcaaccagggcctataaaaaccaaaggtgcctttagccgtctggacccaactggaacatttgagaaagaaatgattggcagaattccctgtggtcgcctggggactgtagaagaactcgcaaatcttgctgctttcctttgtagtgattatgcttcttggattaatggagcagtcattaaatttgacggtggagaggaagtacttatttcaggggaattcaacgacctgagaaaggtcaccaaggagcagtgggacaccatagaagaactcatcaggaagacaaaaggttcctaagaccactttggccttcatcttggttacagaaaagggaatagaaatgaaacaaattatctctcatctttttgactatttcaagtctaataaattcttaattaacn

SEQ ID NO: 1898 - DNA, 782 bp, Homo sapiens
  misc_feature (1)...(782): n = A,T,C or G
gtttnactacnnaaacaagctacttgttctttttgcaggatcccatcgattcgccaaagcacacaaatggcctaccatcttttattcttccttctagcttctggagagagaaatgattgttccagtttagaatgccaggagtttactgggtgtttgtattttttatctgtgccttaaaaaaattagattataatgaacaagacatctttatgttttacagggaaggaaaaagcagtgaaagtatgcattttcgaaagaaaagtgtgttgggaaaagagagagagggtggaaacccaaaggagaaataaaaattttaagtccttgttgcagtagctggaggaagtgagcttggaaatctctccagcgcaatggttgctggctgggaagaaagatctgacttagacacagaataagctgcttgtgctgggtgtgtttgtgagctgggtgaggttttctgtgtcgctgggcacgtgagggaagttacctggctggggggtggggtggggggcattagaagggagtatgggtgtctgtggcgctcgcgtgtgcctgtatgtgtgtgtgtgtgtgtgaaaaanaanagagaangtaaaattaacctttgncctatatggttggtttctctgcntagaagtcttaaaggaaccttgccagcttgcanttttttattgggtttcaaattaccagcatttctcttctaaggattggttgggtggttattttggggttgatgaattgaaagccaagggattaaanaaccanaacctgggaccaantgnaat

SEQ ID NO: 1899 - DNA, 825 bp, Homo sapiens
  misc_feature (1)...(825): n = A,T,C or G
gtttgaatccgtttcaactacttgttctttttgcangatcccatcgattcgaattcggcacgaggcttcatccagccaaagaggtcnttagtggttctggaaactttggtggtggtccgtggangtggtttcggtgggaatgacacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtanctattgcagtggcagaagattttaattangaaacaaagcttatcagganaggaganccntaaaaagtgacangggaagctccaggttacaaccagattttgtgaacctcaacccaaccacaagtgggtgggccagggccttaccttgcttncaaaagaaanacattgtttttaanacnaaatacctcatgttgtattngggccaaaaaaaactcctanggacctggttttttgtggacctnaattggtattaaccaaggtttanttttaaatttcctgttncttgtnggnaaaagtggttaaaagccntttcccaaccaaaangggntttttaaatggtaaaaatttttttttttttggcaccccccattgccttgttttgnantc

SEQ ID NO: 1900 - DNA, 831 bp, Homo sapiens
  misc_feature (1)...(831): n = A,T,C or G
tgnnnnnnnnnnnnnnntattgaaactnatntgnaaaccctggaatttcncaggatcccatcgattcgaattcggcacgaggctgcttcggggactcagccagtatttntactgaggtgctgagcgccgtcctcaaggatctctaccacctgctgaagcacgtagtgtgtctggagcccgatgacgtggccaagctccatgcccagttggccctagaagagctggatgacatcatgaaaaacttcctgttccctccacagaagctggagaagaagatcatggtcctgccgtagacctggctccaaggacgtggaggaggcaggcagggccaggcacccagagccgtgcccaggtcttccagcaggtggccctgctgcctcttgagtgctggcagcatggctgaccctcggggtggttttatggtgcaggtcacttgggtcttcagggtcccttccgagggcatgtgttcagcactccccgcgttcagcctgaggggtgtacagttaagagaagacagttacagatctcattaatctacatttttcactgtcctctaacattgaaagaaggatgtctacctggtgaaagtatattttaacatgactgatggaattcactaattgcccactctcttggaacttganganaaaccggntggccacccatatgtcacctaacctctatattcttttcaggctgaagattcttcttcaaggaaaaatgaaggaagcagaaactgggccaccccttgggctggttcaaagaaggcatttttaaaaaataagganaaagccaattttggaaggttgggggaanggggnaaaggaaann

SEQ ID NO: 1901 - DNA, 674 bp, Homo sapiens
  misc_feature (1)...(674): n = A,T,C or G
cccnccncgaattcggcacgagctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggcttcctctgtgtccgggtccccctgctggggaggagccggccatctctgaggcagcgcctgaagctggcgcccccacttcagccagtggcctcatggccaccccaccctgtcagggggtggtgaccaaanggaggcccanaccttggacagccagatccaggagacangcatctan

SEQ ID NO: 1902 - DNA, 930 bp, Homo sapiens
  misc_feature (1)...(930): n = A,T,C or G
ttnaaatnnanttcannnattnattnnnnnnnaatttnattnttnnnngggggnantanntantannntnanntnttnancttttttatannaaaaacnnccccctttnnttnnttacnntatcnnaannnaaantcngnggnggaatatnatnnnaaattaannantnctnttttnnnnnnnnnaggggggggtncaccccnccaactatttatcattttaaatactngtaaataaancttatattaaatnntttancccttntcttntcccccccccnccacancttntttcnctaaataattcantatantatcatataatacanccatcttaacttntatattatatatatnanncttttnatnnatatatactattcctncantatnncnctaanaangcctctnatntncatttattttctcccncatanaactttctnaaatnanantattnttaataaatcattntaaaattattatacatattttatcntttatntccttattatatntntttcnnntaactatatttattattncatntnnnanatntatactnatnatgntaattnntattaaatanacntnaccttacacattcnntcattataaaatttncattcnnnnatannnnttacaattttntattattaaatntncatttntttacataataanatacaatatntaatatacnttaaacanatccntaaaactattatnntatntntntnttntanatacaaaaattaataaaatntnttcaattntttnacaaacnttantntncatnttacaaaaaanattatctttntttntattatactcatnctntnanntantttcanatncaaatcntnttnttnntnttatttaantatacactnaattatacntnataacntnttattnntanccattacnn

SEQ ID NO: 1903 - DNA, 1148 bp, Homo sapiens
  misc_feature (1)...(1148): n = A,T,C or G
ttnctncctntnagnagnggggnntnnttncttattgaaatccntccnncnntngnaggggggngnaanttnnttgnnaccccnccttttcactagggcctgnntntgtnnaagtacccntgtattttnngcgantgntnnntgaaactgggtaacttnnntgttnagcgtnactngtcctgtggnnacttttnttntccnnnatcttctntcnnancttngtctnatggnangttaggnntngcnattgnttccncacgtctttctgcttnantcacatagncngatatttcnttggantnggcctgaattggtgaatnnntnttggtcgtatananaacncnanntcngatttggncactcncngancccntcgngnattcccgggtttngaaantcttnttctttactccncccgtatnggatatncaacnangtggtaacnnatagncagctcgntnttnaaactctaaatgncnncacgnannantnaggtnntattnntctctactgggnaatnnanntatttctanagcttaattacctatangtcnccntatctctcttgagggtatannnccnantttataacnnngntgtattctccgggtaagngntataaaaccntnggtnnatcanccgcaactactttcaaatgggggnngnggnggannggntctngtctntatatacaattccttcggncggnctcatctcaaagtgcnnnnactnaatngcctntngnganngcttcaaccccctaagctntnanattannngngnganatccgtatatgnctgnggtgttcctcgacgcccctatgggnnantgggggnattgcaannagtntaaatanagactttggtcttctntggaanccccaagnggacgggtnncctttcttgggtccctctccatagnggganncananggcnttgncttngntatgnggtggaacccccctctgggggggaaaatcggccccccanctgggctcnctncaaatgtantngccngnttacgtntttnctcnnctnggntaggancnccnntntaccntctctatcttantttttnttacngntggtatnanggcanacngccgtngagntntccctttgggagnanncacttcncctctttngg

SEQ ID NO: 1904 - DNA, 1194 bp, Homo sapiens
  misc_feature (1)...(1194): n = A,T,C or G
cancaaaannnannnaacnnnnnnnnnnnnnaacnanaaggngnggggggggggannnngnaaacgcaanaanaacnnnntcgnagnnnaaaaaccncccccccncnnnnnaannccnancaangcggnnnggangggggggggggannnnannnnaaanaaaannnncctanngngnnnnnntnnnntntnacgncccccnccganaacaccaacgncacggcggggnggngggnnnncgaaaanacgnagaggacgagaggatggnaacncccacnccccacaantccccggacagnacatcgccncnacnacacnangaagnnggngngggngnnggcaagnanaaactnacanaaancantnccacgcncnaacggancnncncaaaaacancatcanggngggaaacgnanacngcnntacanagggncacacanaagncaccanaagacntananccnaanggaanganccgcaacngaaccagaacantnagncctgnaacgcangaangganagcctntnatgcgncanccacgnaanacctcnacnancgcaccnccnnaaaggccagcangataannacagnatagtcnnanntacacaaccacgagacncatgngncacannacnancanagnaaagancgcggngancnnaagcananacngagnacnanaacgncnccccaagtnaccacaancntnaanaacnnngaanacaaagcgaccannaaagccacacgnncgaaanaatnacgacnaannnaaccancncnaccacnnnngaagcgangcantatggcacnngacancgnaccncggangaaaacngcgtacaccngnagacnacnatcgtccngcngatgggccnantaggcaccnggggaccttnganngnananancataggnnnaaaacacagnnanaaaaatgnactaatanccngngnnnngntcaacgaaannancaccacaaccantcaccaganagnnnggcgaaacaaatcannggccacccctnngtgcncgccccccannaaggaanacccannaatacngcncgngttccccccncagancaanngaaggacccntatacccccaaacggctnnncaactaacggangaancaaanccccccnngacatnagaanaangantgcccacagaaagnagnanngcgcacccac

SEQ ID NO: 1905 - DNA, 705 bp, Homo sapiens
  misc_feature (1)...(705): n = A,T,C or G
ccncgnatcccctgaggggaccatgacttnnnnnntnncagtatgtgaccgagaaggtgctggctgctgtctacaaggctctgagtgaccaccactgcactccagcctgggtgacagagcgagactccatttcaaaaaaaagactgaaacaagcttgtgctaagatggaaagggctgcttctaacagatgtggtttgttgctttagttgttgaagcaaaaatactgagttgttatgtttatgttatcaccccaccactacctccatggttgttcatttaggatgcttctaattcagccactgtgaaccattataaaggttttattgccatgttgaaaatgtttataatatggcaaaaaggggcatcaaatagaagatttactattattccagccatgtaaaaatatgtgcacatatggatgtatgttgaaagtggatgatggagaaataaaatgtggttttctttggggactggaaaaaaaaaaaaaaaaaaanaaanaaannnnnnnnnnnnnnnnnnnnannnnnnnannnnnnnnnnnnnannnnnnnnnnnnnnnnnnnnnnnnnnnnnnnnnnnnnnnnnnnnnnntcnnnnnnnnntnnnnnnnnnnnnnnttnnnnnnnnnnnnnnnntnnnnnnnnntnnnnnnnnnnnntnnnnnnnnnntntnnnnnnnnnnnnnnnnnnnnnnnnnnnnnnccn

SEQ ID NO: 1906 - DNA, 1379 bp, Homo sapiens
  misc_feature (1)...(1379): n = A,T,C or G
ttnnnaatnnttnnttnnannnantanttannntaaggggntgggggggggtnantnnttaaanaananaannnttttggggaaaaagnncccccnnntntntantaangnnntnaagataggggggggggggggtgagnaantntaantatngattttntnnnnaganntaggagnaacganataataataangaaattgnggggagantntagggagtataaaaatcgatatgtggatctaantnatcnnnngctatgtattacgaannattntnantncntntanttatgananatatatttacattgatnatntnannatatntaatgcngtatacgntataatngtttcaatacttanntaanatanntaattnttntagatnttatntataattttacgtcnaacaataatngttangatntttattattatcatgntnttgnanataatttttannaataatttcntatnaatcttancncaaatatnttgtttnntgttaannnataananataattatnatnntaatncaaancnattaataatttnagtttngnntaaannaaatantggtatnnttntgtntnatnanatnnnatnattantanttgngtntganaaagaaactnattgcatanttngaggntantntgaaatnnaatattcacannnttgntntttntgtannacacatatangnnnntatgannnaatanaaataagttangtngatatntantgnnncnttatcaatngtaagtatgttngagnnttgatacntnaataagaaattnataatgtgtncnagtantannntaaatataatnagagtatgtagngctatnaancactntnataaatgaacgtcnatcgttattgcnntattnannnaaagacntatatatanatntaaatnaaatnacganatatagtcnatntntattatanngntaatacnnataatatatatntaagcgagangatgaaaatacnanacaaataactatgcgtagtntntnaagataagaatnataanctnatatnntctatntcatnnatnaganataaanagatgataaancanatagaatnaggtaggntaagttatnctnnaataatnnaatatatnatagatanatagtcgatnaancntaagnatangtacgagtnnagagtatgntantantnaatgctatgtnttatnatcgataantantcgtaaatgtgatatnttanatatagtgtanaatgnacgnntnataangngtgnnantttgaantanaccganataggntacntncgtganattanaagtataatatgctatatanannnnggngnnagaaaganatgatataatatatttcgagn

SEQ ID NO: 1907 - DNA, 676 bp, Homo sapiens
  misc_feature (1)...(676): n = A,T,C or G
ngagaaaaacctgcnnnncgctccccagggttgcttttcccaggaggtgtgagcctacctggaggaggcttaggcacagggatacctgctggaggtctgagcgttggttgagcacctcctgtttgtaggatcctgtgccagacctgtggggaggtggagagaggctaggagacatagcccccacccctgagggatgagacagctccctgcaggcaggctgtgcccagtcatctcaagcctacagctgggctgctggctgcagggtctggagggcggnggggagggtggcagacagagtagcaagacccccacttccctggccttcttcacagacctgcgtcatgcgggcctgggaccgcagcaagcccctgctcttctgcccggccatgaacaccgccatgtgggagcacccgatcacagcgcagcaggtagaccagctcaaggcctttggctatgtcgagatcccctgtgtggccaagaagctggtgtgcggagatgaaggtctcggggccatggcttgaagtggggaccatcgtggacaaagtgaaaagaagtctcttccagcacaatggcttncagcagagttgacctgggaattctgtcattgggtgtcccttctgtactcanaaaatgggttcaggccaagtcngtgaaagatngatgtttggcaaaaann

SEQ ID NO: 1908 - DNA, 785 bp, Homo sapiens
  misc_feature (1)...(785): n = A,T,C or G
nnaancncatacangctacttgttctttttgcaggatccctcgattcgaattcggcacgaggggagaagagccgccagcggaacccctgtgtgcaccaaccttccccagagctccggagcgccctctcctcacttccaggttttggggccagagnttgncgggagaccgccccagcttccttctgaccttcagttcactttgtcgcccttggagaaagatgtttttnttttctnaaaataaccccaatgctccaaannnnnngnnannaaaaaaaaaaaaaaaaaaaaaaanaaaaaaanntaaanaaaaaaaaaanaaaaccncgaccctttaaaantntagggngtcgtttnncntananccaaacttgataanatccnttgntgngttnggncaanccananntaaaatgcngggaaaaaaangntttnttngggaaattgggnangctatggnttnnttngaaaccattntaagntgcaataaacangttancaccaccantngcnttcnttttatgtttcaggttcagggggaggngngggaggttttttaanttcgnggccggggcncccaatgctttgggcccggancccagnttttgttcctttaagggagggttaattgcccccttggcgtaatcatgggcntagcttgtttcctgggggaaaatngttttcccgttcnaanttcccnacaaaaatacgagccggnagcnntaaagngtaaagcnngggggggcctaatgnagggaccnactcnatttaattggggtggccncncn

SEQ ID NO: 1909 - DNA, 957 bp, Homo sapiens
  misc_feature (1)...(957): n = A,T,C or G
nnangnngtctananagnggggtgtnttngatttcgaacnncnncanttnaagaatgcngggnnttnanangttgtannagnggngnggnaaantnntggttnatagantannnannnntaatcgacantcnnntgtncnttttncnataaggnaataanttntgngcgatgtctnntgnnatgtatnntactnnatcttccctcatgancntnnnataacntnangaatnntagactttcaagacttnntgntaattntatnntaacngtggatttnttnnatagntnnatnannnctancgtnntcnncnaaannantntantgntnatnataatanntagntcttantnnngtttanaagatantnnattggnntgangttntatanncttgagtcnnnngaccncatantaanttgtttncnaatattatttntaantanntantgnttnntncanacntttntgnanacntttaaannnnngccnnaaanntcntcaanntncntctngtatctngcntattnttcagaatncancntcccttttnntaacatnctgaatnnnnataaaannanatnnntnnanatanntatnannnntatnacnatctnntnatganaactntanacttttnanattcananncatnncnagtnantaattaannntntttntattgnatcangnatttnnatnntcanntcgnanantnngatgnataaannnagtcatannaaagattangtacgactgcggtncaacnntnnnannnnntgaatnatgannttngananaattttgtgnangataatgctnattnaaantatnncactantataacnancatntnntntntgantaatnnnaatattntnnanatatagttngacntnacgtgnnnnctnantgagcagnatangttatcnagatatnntntanctctccatgaccac

SEQ ID NO: 1910 - DNA, 682 bp, Homo sapiens
  misc_feature (1)...(682): n = A,T,C or G
gcangaggcctgcatannnnnncattactcaggagttggaagttcagatggtaactcagaggaaagcacactggggaaatggagaaaagatgttctttctataattgatgacttagctgatgggccacagattcttgttggatctagccttggagggtggcttatgcttcatgctgcaattgcacgaccagagaaggtcgtggctcttattggtgtagctacagctgcagataccttagtgacaaagtttaatcagcttcctgttgagctaaaaaaggaagtagagatgaaaggtgtgtggagcatgccatcaaaatactctgaagaaggagtttataacgttcagtacagtttcattaaagaagctgaacatcactgcttgttacatagcccaattcctgtgaactgccccataagattgctccatggcatgaaggatgacattgtaccttggcatacatcaatgcaggttgccgatcgagtactcagcacagatgtggatgtcatcctcccgaaaacacagtgatcaccgaatgagggaaaaagcagacattcaacttcttgtttacactattgatgacttaattgataagctctcaactattagttaactagtatcacatgtttagttgggtattgtaaacctatgtatcccagaagantgggaaganggataagaaan

SEQ ID NO: 1911 - DNA, 875 bp, Homo sapiens
  misc_feature (1)...(875): n = A,T,C or G
angnngaaanaanagngggatnnaanattggaaaccnnnnnnatgagaggnggggtnaaatgatggnntntggnaaatttngaagaanaaaaananaaagtattaancggaggaggggggaagtgnataaataattntntnannanagantnaannntaaaaatanttnatcaatttntgantaaaanttagattannaatctnatntttggagataaatattgntaaaatataaaaagaaaagtaanaatannaagaattantatantattantatananaanaaaatngtatgaantatnatantttaaaaannagtaananaatannnntatnaaaataanactaggaatnnatnantanaantttaaaaaaaanaatanataatanaaattaaaaaatanttcnaaaaaantaatgtanantaaaaaaaanataaantaattaangaaatannananaaataaaatntataataannataaatatataataataantantatnatnnagtntnaaatnataatantnataatataantannaaaaaatataaaaataagaagatatgnnaaangaaaaaaatatanaggaaaagtaaattaatngatatttaaagaanaaagaaaaaanaaaatatanannatnanaatatantataantnaaantananaaaanatncnaattntannagatnataaganaanntatnaaatnaacntgaaatatatntaannatagnacttatanatnntataaagangnnttaagganaatanatnaatagatanntnaaataaattataatatataaaaaatannaaataatgagntganngattatannaanntatanngtatntaatataataan

SEQ ID NO: 1912 - DNA, 671 bp, Homo sapiens
  misc_feature (1)...(671): n = A,T,C or G
gcnggagggaaatcatnnnnnnaggcaagcagtttcaccggatagtgacataccatcgccacctttatgatatccacgtgactgttcagccaaagtataaacacgtttatcctaagaactctgtagtaagaaaaagccatttgtagggtgcttaagcttgtttgtaaaatggcctacttgaagtcctcatgaataatgagggttgactttcatttgcttgaaacttaaggaagtttgtgcctataaaagttactgcaattcagtatttctttatttttttcgagacagagtctcaatctgtcgcccaggctggagtgcagtggcatgatataggctcactggaagctctgcctcaggggttcatgccattctcctgcctcagcctcccgagtagctgggactacaggcgcccgccaccatgcccagctaatttttttttgtatttttagtagagacgggttttcaccgtgttagccaggatggtctcaatctcttgacctcgtgatacgcccgccttggcctcccaaagtgctgggattacaggtgtgggccaccacacccagccttttttttttttttttgaaaaanagngtttatttttgccaaaacccagggtggngnggnngggccaaatntgggttnttnaaacctcccccnccccgggtccancn

SEQ ID NO: 1913 - DNA, 685 bp, Homo sapiens
  misc_feature (1)...(685): n = A,T,C or G
ccncnntccaangggactatcctctggaggnnnnnccatgcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagcctacctgtatgtcaataaacaacagctgaagcaaaaaaaaaaaaaaaaactcgaccctnnaaactttagggagcctttttccntaaatccancttgaaaaaaancttttttgatttggnnn

SEQ ID NO: 1914 - DNA, 690 bp, Homo sapiens
  misc_feature (1)...(690): n = A,T,C or G
ccncnntcnaattcggcangaggccagatccnnnnnnnacagcngaaacgcttgttgaatggcttcagagtcaaatgacaaatggacacctaccagggaacggagatgtgtatcaagaaaggctggcacgtttagaaaatgataaagaatccctcgttcttcaggtaagtgtgttaacagaccaggtggaggctcagggagagaagattcgagatttggagttttgtcttgaagagcacagagagaagttgaatgccacagaagaaatgctgcagcaggagcttctaagtaggacatccttagaaactcagaagttggatctgatggctgaaatatctaacttgaagttgaaactgacagctgtagagaaggacagattggattatgaagataagttcagagacacagaggggctgattcaggagatcaatgatttgaggttaaaagttagtgaaatggacagtgagagacttcagtatgaaaaaaagcttaaatcaaccaaagatgaactggcatctttaaaagaacaactagaagaaaaggaatctgaagtaaaaaggctacaagaaaaattggtttgcaagatgaaaggagaaggggttgaaattgntgatagagacatcgaagtacaaaaaaaaaagcctttaaactatagngagtcgtttacgtagatccagacntgataagatc

SEQ ID NO: 1915 - DNA, 780 bp, Homo sapiens
  misc_feature (1)...(780): n = A,T,C or G
annannnagaggggaatanngantnagttnnaannccatntnnannnaaananggggggnnaatannatnnnnttgnggccnaatctgnacgataaacaatgangtcaaatcctanatgccttaatatntgtacattnatanaacaattatatngattatcnancnaaagtnactgtgaagagcgataaatacttcactattaaganactntcngcngagaacatttcagtggaacanttngcaaaaanatttnntcaaaaatgngcaattcctgggaaaaaaggaatgatggaangaaggttantagcagttttncataaanaattagacannatnggcctgcattnntatngactaangaatcccaatttatannntnaagaccattaatatatgaatacataaggccataacatntnaaattaancacatggagtgatttgtnatntcgtgntaatttaaacntaagatgttattntnaaaaatgatcttggaatataataaanantttaaanntgaggaanggaaggtnaaaataaaaattnctgataacccttttctttatgaaatcntgctaaataaanaataacctaggatatacttaanaagaaccaagccaanaaaaaattaccttttaagnaancanntcnttnanttnatntttctttctgaaatnaatacncnaattttaatgaccncaggattttnncngatcttaacggnaaaggaataaattaaanaccaaggcnncatatacctcttgattcattnnaataaan

SEQ ID NO: 1916 - DNA, 848 bp, Homo sapiens
  misc_feature (1)...(848): n = A,T,C or G
ccgntnttccgaantcggcacgagaagactttctcctaatgcttggaaaaccataactgacatagttctaaatggcacagccttcgtgacactagaaattggaaaacaactaattaaagcacagaaaggagcagcatttctttctattactactatctatgctgagactggttcangttttgnagtaccaangtgctttctgcnctnngcaggtntngacccangnnctantctcttggcntttgaatggggtgattntngcngtgnattnagctnttcnatcnctgtnntcagagcntattnttnatnntnaccntagtactttanngctatnacagtatcaataantnnttttttntnttctacncactntttcnacaccctncgaggancgagttccatnttttgctnacaaacnagtnnncttngnatntannaccggancctntcanttnnggatntnanaactggagctatggnggnttaccttgcntttaacntngannaannccntctacnaagcaatgggcatttgggcccncgtnnggggatttctaagaaancttggatgnaggtggganatttcacnnncncaattggnanngcgtataggcctagaaacantttggnaacggtttgnaanaattctgnttttcgggncantttngggtgnaagnangggggcntctaaatgtaaaccataactccttntcgganaanggttnggaaaaaanattttnttaaaancctaaattccangnngcnncaaacctttttccatttttgcacnggaaattannggggtaaaaggccnttcctggaaaaaattntggcnccccttaaggttn

SEQ ID NO: 1917 - DNA, 690 bp, Homo sapiens
  misc_feature (1)...(690): n = A,T,C or G
ncccnntcnantngccggcaaaggacttnntnnnnttgaaaaccatgtaaagtttgatcatatcattagctattggtcagacctattttgttgtttgagaaaaacagncacatggggaaaatggtgaggtgaggtagtgtgttgaggagctggaagtgagcagctcttaattttttcctcctgagactgagttcggaagaagagtagaccatggcatggaggtgggagagacaaggacagagttggggaggtcactgcctcacacttctgctcacaccgctgggtctggtggaaactcaaagtttgtatctaaaaatgggaggtgttgggatagagtttgcttcctaatacaattgaaataaatcaggataatgttttggtgctatgtaataataatagttaatatgaccaattattctgtgccagacacaattctgagtactttttgagtgttgtctcatttaatctcttcaaaaccatgtgagaggcctagcgtggtggctcacacctgtaatccctgcactttgggaggctgaggtgggcagatcatgangtcaggagttgaagaccacctggtcaacatggtgaaaccctgtctctactaaaaatccaaaaattagccaggcatgctgctcacccctttaatcccaactacttgagaaactgaggcaggattatcccttgaagccg

SEQ ID NO: 1918 - DNA, 1325 bp, Homo sapiens
  misc_feature (1)...(1325): n = A,T,C or G
acnntaacttnnntnttnncntatgntaaggnggggggggttnnnncnngtnatanttttaaataaaancccctttttatttnntnantangtaggggggggggnatttccacncgnnttttgggannnagcccnnnncctccgatattnnantatatngngngngaaatactataacgtgtgtntatatatctcccccccctatatcggngngatactcagnanntanacatntnntnngatctccactncgagnnatcanntgnatataatcnncnncaannagnntatantcantcacatagatgngactatattntanntncnttctcnnactntntntntnnactaatanattntgatncnccntattatntcngatatcntcataacagtntnatantancttntcnngtanntaannttatataagtgttnactnnacnagatanattataagttangncgttntcnanctganaactctttattgnttntnttnatcanatnatnctttgctcaatcnacnttcaattntgaatagntnnctntnngttatgatattntnnntttanatatctntntgantnnantactaagctctatncaacattnnatattnnnaannanacgatanntnnnctttcnttgtacctcatcntntctngtatcangattnngacncgnctcncttntcgnncnntcntnatattatntntgancttntanacactatattctntatcaatangtgtatagtatgnanacatngcncatancgtaaacataaacntnatngaatgatctnatttataataatatattnatatatcannaactatcatgttatcctnngancatatatatancntgantctttagtncntcnancattcnanatacgtcttncatnccgctnntttgnnttatnccntattgngantgtgtnctancntnttnncnaacgtgtcgtantatacagtntanntatgtnnttatancnnnacatccactngtacgatatatncanngcnnancnnnanntatgtaatntngcnactgnntnaantnatncncantatgnananatnnttnntntncattgnatcnntagcttttatcatgcncnanagnnncacttgtannngttngtatatantntatatcgctntcctnnttgangtatntattctgtgtantactncttcgncncannactcagatcnnanatttcnctcgtnngangcatgttaantactcncnngttanatatatnatatatcanttctctatattntatnaacttgatntatannactntaccn

SEQ ID NO: 1919 - DNA, 662 bp, Homo sapiens
  misc_feature (1)...(662): n = A,T,C or G
ncccgatcgantcggcacgactcagctctcaccagctgtcagatgctgccacagggcgagaacctccaagatgtgctccccagggacatctactgccgcctcaagcgccacctggagtatgtcaagctcatgatgcccttgtggatgaccccagaccagcgcggcaaggggctctacgcagactacctcttcaatgctattgccggaaactgggagcgcaagaggcctgtctgggtgatgctcatggtcaactccctgactgaagtggacattaagtcccgtggagtgcctgtcttagacctgttccttgcccaggaggctgagcggctgaggaaacagactggggcagtggaaaaggtggaagagcagtgccatccattgaatgggttgaacttttcacaggtcatctttgctttgaaccagaccctcctgcagcangaaagcctgcgagcaggcagtcttcagatcccctacacgacggaggatctcatcaaacactataactgcggggacctcagctccgtcatcctcagccatgacagctcccaggtggaggttcccaattttattaatgccacgctaccacctcaggaagcgcatcactgctcaaggaagaattgacagctactttaccccgggaacttgatctacaaaccggaatg

SEQ ID NO: 1920 - DNA, 663 bp, Homo sapiens
  misc_feature (1)...(663): n = A,T,C or G
ccncgnatcgaattcggcacgaggccacctactgcgtcttggtcatggagaagaagagctggagacagagaaagatttcagcagaatcctcaggatggatttagccgactaaaacgatggattatgattggcgatcatcaccagttacctccagttattaagaacatggcctttcaaaagtactcaaacatggagcagtctctcttcactcgctttgttcgcgttggagttccgactgttgaccttgatgctcaagggagagccagagcaagcttgtgcaacctctacaactggcgatacaagaatctaggaaacttaccccatgtgcagctcttgccagagtttagtacagcaaatgctggcttactgtatgacttccagctcattaatgttgaagattttcaaggagtgggagaatctgaacctaatccttacttctatcagaatcttggagaggcagaatatgtagtagcactttttatgtacatgtgtttacttggttaccctgctgacaaaatcaagtattctaacaacatataatggccaaaagcatcttattcgcgacatcatcaatagacgatgtggaaacaatccattgattggaagaccaaacaaggtgacaactgttgatagatttcaaggtcaacagaatgactatattcn

SEQ ID NO: 1921 - DNA, 909 bp, Homo sapiens
  misc_feature (1)...(909): n = A,T,C or G
aaannnnnnnananagnnggganaannaantataaaaattaattnaaanagnnggantanannnttnnnctntggaaaattntnttnagataaaataaagtnagaattacannaattaattaaacnaagannnanatttnnaataggaaagataaaanaaaanagattantaaattataaanatanaantgntggaatntgaaattaatgaanaagntaatattaaataaaaaaaagaaaatgtaancattatngaaaatagtnnnaaggattaaangaanaaacncaaaaaanaaatcantnntaaagnnngnatagnanaaaaatnatataatnaaaaaaaatangtttnaaaaatgtganaaanaaagattaaanacancnantnattaaagagtnatacnagtnggaatgaaaaaanangatnatatatnnntaaagtaaagaatganaatnaattnataantaagnaatatagtaaataaannagnngnntaaaaattaaantgggaatnnaaatgntaaanantgtacanataggagatggnaataaatttcnaataatngattagaaaatnntgtntatgaaaagaaactgtgnnaatataaaganncaactactattaatanaagctangatttgtttanaanantntataatggagntaaanaaatngaatngngaatatgaatattgataattatctaaaaanaaanntttaatattngagatattnngattataaggtatttatgcgtnnntaataagaagttaataatcattaaaattanggantntttaanaataantgtnnatgggngtaaanaaacaanaaaattanaangattaaagaanttaaanaaantnntttagacatataaanaannatnannannnatnattaaaan

SEQ ID NO: 1922 - DNA, 1325 bp, Homo sapiens
  misc_feature (1)...(1325): n = A,T,C or G
nncannnnattattctcncncnnaatnnaaggtgnngggggggttttnctncaactncntanntttttnggnatnnnccccnantgnatangntnncnaggatanngngggggggggttnncanantatagntttttgggnnagananacccgtntnccgnatntaatntntagattgggggantattntatantatgagngggnnatgnataccctcttcattcngnanacacnnattanaatatgctnatgntanctncnctctnntatntcntancgtatattttnttcaccatnanatnnntnntcncatcacncnntannatnnatttntncaattntncnantcnncantcgtntanaatcatatcntanatnnctataanagacgctctaactaatcgcacntatnntatttatcnntannngagtnttntatcntatatcaatatanatttctcttagatccnanttacnttacctntannnctcntantattctnactnnnnnntcnacgtnacgnaataatancttctatnnacgctcgntgatgncnactgntnntattnnatnnaatactacttctcnntcntncnnncntctatcacatttncgatattgaactcgtntntatnctnccttanntcatnnttntnacacantanacatcanntangnatnntgctcntntancntnatctnnctanatctctctatctantannttntacnctagcnaannctnntcnnatntattnantacttcaatactntntnnactnttttgacctnatttnctnnnnttgttgcttttataacatntantntannntctgacncttatancgatntatctcnatannantttncncnctatntntcnctttatnnntngctcacnatatnnacnnnncataagataaacntccnantnatttacncatagatntatangtaanattatgtcatatgtccttcantntnntntgacatatgaatncagtacctatatctgatcnngcatatannctcgcnacnaacnctcatanaantatccttatatanatatgaattngtgtangagntatgccgntaacgtgntcnatacgctctatatatgcaatnatttttttcatacncatgtacagtacntctatgtnntatntagtanatgtctcnactatganctganantattcagntatagtcccttncnactcatctcgananactctntcactatnnatatannttctctnaatctatnnntatatctctcttgatncttctcacaaaanatgagantcatgtatatntangcgn

SEQ ID NO: 1923 - DNA, 823 bp, Homo sapiens
  misc_feature (1)...(823): n = A,T,C or G
nnttntnnnatannggggnnnntttntntttgtacncnttttnntanncagnggggnaaacgcgnttnnnnantcccccaagtttacttgggatnaanntgnggtggggaatanctgtatgaatatanaccncggnngacctgntagangcctgnanatgctgtncacagctcngggttttgggatantntccgtggntactgtatgtnacgganagttatagcctttacttactgtnctccctnactttggagngatgagagatcngnnttnganntcannatcntgttggatggntantctgnctacggngctgntatngcaaatcacntactgngattgagcacctnactgttttncccctcctctnctcttagattctgnttgnnccggttattctctacctacctcgangtaatgtgtntctcgtcactcctatctantctccttncccttatcttctntgccttnatntnnagaatctgtggngnanntcctnggcatcataancagnttnatctnttanaagntnttngtgttnagtaaanaagcccattntgtgntnctttnatctagnnntntcggggtnnggaaaannttatnnnnattanttnaaggtggannntnaancgtntgaatatttctnatgaaactgggnatntgtngtcctaatagggagtnatnctantgctactgganagangnttggggatttttcaatgntaagngggnttggactcttatcnngtganatnnntnanngggggtnngngcgngctnaacnatgntntgaaatanttngngggtnnggcntanaananng

SEQ ID NO: 1924 - DNA, 1171 bp, Homo sapiens
  misc_feature (1)...(1171): n = A,T,C or G
attantnactanaagtagtggggannnnttanttatttnaantcnnntntntnangnggtnggntnatncnnnatttnnnnatnaggncgaatnncnntcttntaaattnaagngtttcgcntnagggactanttggtctaaacttgtgtgctcnattctgggnnaatntagtnttncantcttggactnagnggtaatgnttnttcananttattctaacaggnannatttnngtnntnnttcaataaggngtgtannnnangtgcgnganngannnaanntggttaatgntggtnatcataatagattatttntataatgccatacnannnagngtgctcttnnngaatantgattacttgntttntagttgatnanngattttgaattgnngnattttctaangcgttanttngctanaaatcggggngtngttgtgntagttaacntgannnatccntnaggcngtcngcnatanatnattcttnanacatccagtntntagntttaantntattgngantaggggtggaacattnnggaactcatggattgcctatcnntttctttatcatncgatgggttaanngttttgttatatgatagtatanatnnnangaanaatgatttgnntaaatatctacnttgnnataggntaagttattctggnatngtgttattngtcnagaatctggntctnttnncatancngngganntnntcacgntcntgntnangattatncnnnatatatatacgcntttctgtatttagnanatntntattttgtgaantaanatntacntnatnngntngtctnatnttnccgcantatatnngnatngatntgtnctatnattnttnngaggtnncatttggnaganctngnnctcantngacgaatttntntcttgtacanantcgaaanatncggtaanaagggacnaaatntgtgcctcanacatnacacantacggcatagtgacatctnaggnnngatcnntagtnataaatctctacccaganntnatcacttantnnnggtnnaaatnntctctatgttttgagtgggcnaattgnattatctnatntctgtaaggcnctntngcggntactanatntctanatntactnntcttntancnttgngnntntnctcacctncgngnn

SEQ ID NO: 1925 - DNA, 1010 bp, Homo sapiens
  misc_feature (1)...(1010): n = A,T,C or G
tntcgttnnctnatagnggggtctntgtnattttntnncanntnnaatagaggtgggagtctagnnttgnnnnnagacccgagtgagtgaggggttnatnnngnnttnagncnnggngtgcgntttttntancntanaaatctnttntcgtnnanttntnttngctaanntttanntagntaanangttttaagtntagntccntnnantatnatgnntgntnttaagntcataatnatntnnncaagatntgnnanngtgcttagaaagtaaattattnantttggtngttaagtagatntgtatnagnncnaaatanatnnaatcgattgganntttgtnttnaatatngnntncntgagctnnannnaaaaantgnaancantnaantttnanntcatnnagtnggaanttaagttctnntnaacattttcntnttcatttaattgatatattattagtgataaanggtactaantttngtattattnnnnatnatggtaatantcagtttgcantgtnnttattnngtccnaangtngaattgtnaaaaatgtgnatnnnnanaatngcgtagntataanatnnggntntggnatgganctnnnatnttngtnatgtattngntncanatnnntatcagatatngntnaggtntngctntatnattacangnttattnaagtnngcattatttngtctacggcatnatangnanantnnttanannattnnnntgganananattnnatgttgaantgggagataacnntaanntgntgtttnnnaantgtatatcgnatattncncatnntangtananatatgannagtttaangttnntatgantggntcncnatgttatattnnttcaggtatagngantatnggtannacncnatanattgnctcatgatnatgnganaaatggancnaantctanatntttganatgaaacatagntagnaaatncgatgtgtnagaangtatggttgtatngcanatng

SEQ ID NO: 1926 - DNA, 665 bp, Homo sapiens
  misc_feature (1)...(665): n = A,T,C or G
gngntcgaattcggcacgagacnannntncttatcctcanaacacnttagnnnagctctnnagtaatctggctacnagtatgccntagaaaagnngacacattnnctnaaanatgatgatagagaacangtgatnttttgngcngattaccaanganctttgccctgttgagngtctggnggatcatagggantcctnnncngccnttanantnatngcaaggtcangatcgctgagggntgagnatgganctntcatacctataanggcaacctngagttgatcnaaaaaangnnnacntnctcnnagtacaccnactcanancanngnngacatntgcatnnannnggacaccntctcattaatantcaaaggataanntttcttttcntatgacancncctacnnccacnngtnacncanggcncntcnctcnanacagtaaacccaanncacnntgcncaccanatcacctgtncagaggnttatgcctnagcatatttcttttaagccgaggnnaagttcnntatgccacccctgctttgtaacaaanttatnttaaagtgactggaattatctattccccagatngatcatcttcccctgcaacgngactctgtntcctgcgcggnttccatgctgactagtcccctactgntaatatn

SEQ ID NO: 1927 - DNA, 1035 bp, Homo sapiens
  misc_feature (1)...(1035): n = A,T,C or G
aaaannaaaaantgaggggnnatanatatatanntannaanaanaagangaagggggataaaanagatggnnggcnggngggannnatatgaaagggagnanagaananangnggaattncaatatgantangtaatnataaaaagagaaagtnggaaanaattataaganntantataaaangaaaaaaatantatganaatnaatangtnanaagaaatataaataatanataataaaataanaatgaanananaagangtaaatattagnaatatgaantaaaataatnnnaaaatanaaatnannaaaaaaaatanaatgtnaaaaannaatananggaaatntnaaatanaanaataangnantgataaaatattanatataanaaaaannnaaaanagnaaaaatntaaanntaaaaangagaaantgaaaataanataantaagaanataaataataaaagtataatatgaaaaaaatanataataaagaanntataanaatgaaaagaagatgtaanntnantatatnanatnaaaaaaganaaagngaaaaaanatattnaatataanattanaagatataaanatngatagaaanaantaanatgagannanatagagaagataatannataaanaaagagtaantaanaaanaataaatgannaantaataaatanataaataggtaaaangaaaataaaaataaaaaganannnaagatgaagaagnaangaaaatgnaataanatataaaannnagnatntnanagagataanaagnaaaaaaaanaaanananaaaagnatgannatanaanaaataaaaagtataaatataagaatngangaaagangagtanaatgatagngactaactataaagaatatnanagnaanganatgagaanaatnatngaataggaaanataannattatntnaanatnnaattagntatnaatatnaatgannataaanaaantatatgaaggaaanangaanaataaaaatnaangtaaaaaaaannn

SEQ ID NO: 1928 - DNA, 665 bp, Homo sapiens
cccgatcgaatcggcacgagggaagacacaataattttaaattgcctacagcaggggttggcaaatagtggtgcaagggccacatctggctagcagcctatttttgagaatgaagttttatgagaacccacacatctgtttgtagattgctatggctgcctttgagttacagcagtggagctgagtagctgtgacagagactatatgacctacaaaaactaaaaatattggtcctttacagaaaaagttgtctgacccctggcctactatttcaaatcctgggtaggtcctccacgtcagttcttcatggaactgtattgccgagggaaaggcagtccccacactgtgcagcccttcatgctgtgctcctggctttctctgccatcctgagccgcaggctgtggggcagcgcagcaccagcactgcagctgagcagaagttttgtgcccgcctgcccccatcccctccaggccacgttttagatggcccttgtagttgcgggtcctgggtgtcctcagaactagacatcaatgcctggatccttcagcccggccctgccctcctttaggagacaggagtcaccagggcacagccctccagcccgcctcaggaaggaatgaaaggaatgccatcatctctagttcccagggcccagcctttccctt

SEQ ID NO: 1929 - DNA, 665 bp, Homo sapiens
  misc_feature (1)...(665): n = A,T,C or G
cncnttcgaatcggcacgaggattgatgtaggttttaaaaaaggcatttgtatgttgttagcttacatatggggctaggtaatttcattgcttaaaaagatgcgcctaggctccctcttggtggctggatttctttttcttcgcccgtggtggccatggttcttaatagggccaccggaatcatggtttctttctttttttttttttnnaaanggagtntccccntgnnaccnaggntgnagngcaggggcncaatntnggttaantgaaaccttngcctcnngggttnaccccnttntcntgtntaaccctcntnagnannnggaactacnggnnaatnccnccacccccggntnattttngnnttttnagaaaaaanggggtttnacnataggggnnaggntgttntcaaactcnnnacntaagggnanccncctgcntngnccnccnaaagggntagnattacaggngnnacccaccacncccgncccnaaanaaagggtttttgnactttctgaacccctngtncntnagtctgctggnanattnangtggaccttaatnattttttattctgaacccctnttaacntttaatgngaaatntaaaaaattaaaaagtanaanggnttttattgttttgacacctttgaaatttttataaan

SEQ ID NO: 1930 - DNA, 673 bp, Homo sapiens
  misc_feature (1)...(673): n = A,T,C or G
cccncnncgantcggcacgagggcacagtcctctctgttcatagaaacacctgccagtgtcaaggattccagtcaggtgtctatcccaactggtcagggagagaagggcagacccattctcaaagaccaccatgtccaaggtctgacagctccccactggctgcccccacaggggctttaggctggtctgggtcatggggaagcgtccctcttatcgctggtctgtgttctcctggatttggtatctatgttggtacgactcctggccttttatctaaaggactttggcttttgtaaatcacaagccaataatagacttttttctccccctctgttttttgctgtgtcatctctgccttgagactgccttgagacagtgcttgccttgagagagtgagccaattaacagctgcctgaattgtcattttccattttggtttgttagaggtgggaggggtgggttttgagaaggtcaaaagcaataccagaagtaaagggaaatatcagacaatattttattattttttcatagatgttctgccacacaaagaacttggggtgtaaggataaaggcaaaagcctccaatcccatttttcaagttctcctangatgcaccccttaagggagccctggccagagttccgaggcccgtgagcgtcaactgttgctttn

SEQ ID NO: 1931 - DNA, 667 bp, Homo sapiens
  misc_feature (1)...(667): n = A,T,C or G
ccnccncctgggaggaataattcaatttgattggcagatatatataatacagtaggagaataatgggagaaagataaattgagactagaataggtagactttaaatgcctgtctggtttaggtatttgaactttcaaggtgtggtaaatgtttgagtaaaggaataatgtgtccaaagattattatggaattgtctctctgcatacctctatcgctgtttgtcacagctgtgttcttatgtgactgattcttcctgaagattagaaactcctcaaagactggttattagagcttattcttcattatagccccagcacttagtgcaatgacagaagcaaaaatattaattgaattgagagaaaattgagatatagagacgagtcatttttgttcacaacagaactagtatttaatgaaatataatggaaaagactgagttgggttactgtttaactgagagcatcagagatggataggcagggaggatttagaactgagagtgaattacagcaatgagggaagcagaaagctggaagttgagagcgtttggcattggggagagtgctgagtgagcagagtttttggaggtagagaaatttataaaactaatcagaatgaacatttcatttgaagtaatagggtaagcctctgaaaattgttcctangt

SEQ ID NO: 1932 - DNA, 708 bp, Homo sapiens
  misc_feature (1)...(708): n = A,T,C or G
cccnntccnantcggnngngcaacnacntngnnngncccccctcctataggngaattcaactcantgcccgatntnnctaatacagtcaggntnntanngngngaacnanaatttnntactannanacntagactnnaantgcggngtctggtttatgnntttgaacttgcncnagagtggtatncgctcncataaaggaanaangtgnccaangattattatggaattgtctctctgcatacctctatcgctgtntgtcacagctgtgttcttatgtgactgattcttcctgaagattagaaactcctcaaagactggttattagagcttattcttcattatanccccagcacttagtgcaatgacagaagcaaaaatattaattgaattgagagaaaattgagatatagagacgagtcatttttgttcacaacagaactagtatttaatgaaatataatggaaaagactgagttgggttactgtttaactgagagcatcagagatggataggcagggaggatttagaactgagagtgaattacagcaatgagggaagcagaaagctggaagtttgagagcgtttgncattggggagagtgctgagtgagccagagttttggaggtagagaaatttataaaactaatcanaatgaacatttcatttgaagtaatanggtaacctctgaaaaattnttcctaggnttn

SEQ ID NO: 1933 - DNA, 641 bp, Homo sapiens
  misc_feature (1)...(641): n = A,T,C or G
agagtttangaagaaaggaggatttgaagggggaggattccttggaagaaagaaagttccctatctggcatcatcaccaagtacttccagagtgctgggattacaggcatgagccaccacacccgacacttaaagggcatttcttatttatccttgttttagtcacaccatagtggaatgagtaatcagttttagaagctgcaaatttaccattctctcaaagatgctagtgtaatagggcactttaattatgagtgggctatatgcttattctgtatgtatccttcttagtgagttgagaatattatgtattctaatgctttttttcttanactgaattgggtgactaaatacatttgtactatataattntagtgattttaaaatccagctaactttgcaaacttggtttggaaatcttgttaaccactaatatatacagccatatagataaatggatgtttagttcattagatcttattaactgacaattaactgttttaataggaacaagagtttgttcagaaaccaacagccaagaatttagatggctctctgaaaaagatcatcccancagcagaaggcagaagttagctaatattgagagagagtgcctggaataacaaagcaacagnttcatg

SEQ ID NO: 1934 - DNA, 657 bp, Homo sapiens
  misc_feature (1)...(657): n = A,T,C or G
cctaggtggtataatgtgatgtacattacacatgaactatctacactcactaaaagccattatttaagagtaagctcacatagcacacctatttccttggtgttgcaaagcttgaggttgcacagctttctcattttgtagagcaaatgacagttttcatcaacagaccaatggattcacagctaagaataagacaacttgaaaactccacgttttacaaaatcattttctattaaattataaaaacctctgggatccaaactagcaaaaaatgccaattttcaaaaaaaaaattttttagtggaaaatacaaatatgggctctatctaatttttaaaaagctggagctgggcatggtggctcacgcctataatcccagttctttaggaggctgaggtgggaggatcatttgagttcaggagttcaagaccagcctggacaacatagcaagactctgtctcaataaaataaattttaaaagccgggtgccatggctcacacctgtaatccccggcactttgggaagtcaaaggtgggcaggtcactttgagatcaggagtttcaanaccagcctggccaaatatngnngaaanccttgttttttttttgaaaaaaaccaaaaaatttaaccttgggccatggtaaacaaggcncccn

SEQ ID NO: 1935 - DNA, 646 bp, Homo sapiens
  misc_feature (1)...(646): n = A,T,C or G
tgctgccgcctggtcagtattgggaagcaaggtgaccgcangggggtatgatcatgcagcccacttgttccagggttcaccggggcccccaaccgtttctactgcagccaaaccanataggctactggtggggcaagtccaaggtctncgaccatgccacctgccctgggggctcccctggaaccccggcccctggattnagctctgcagcctcctccgcactcaggatcagccctcctgtcctgccactagcccttttgtccccaggttcagcgatacccaggccacgtgcccaactttctgagccanacccagggctacctgcggagtccacaggaccccctgcgccgggcagccaccgtgcttataggcttncttgtncaccacgccagccncggctgtgtcaaccaggacctgctggactccctgttccaggggcntgaatgaggaacgcgccacttggacacatgaggaaaaagctgcccttgggagctactgatgctgtgacctcacctctctggntttgggcggnaggncccttgcacctaggatgcctngccttggaaaangnccttgcattcgtgggcctccnttanaggcttcttcttaaaagaagcctcttgcgaatgcacagggaagtgtgnca

SEQ ID NO: 1936 - DNA, 654 bp, Homo sapiens
  misc_feature (1)...(654): n = A,T,C or G
tttgaagnnnnncnccgcaaatatgccaaattttgtattataattcaatctgtatgacagttatgtgagtttttttttgttttgttttatgcttgtgtgaagatttttgtagttaagctttttttaaaaaaaagtcaactgagttacttacgtgatgaaattagaacacatacttcttacaagcacattctctcctatccccctctccatttcagttggcaccataatgccatttttgcctaaccataacataaattaatatcattttattttatggagtttttctttctgggataataacatttctgctttgttgcataattatcacagacaggtttttctttttttggagatggagtcttgctctgtcacccaggctggagtacagtggcgcgatcttggctcactgcaacctctgcctcccaggttcaagcaattctcctgcttcaacctcccccagtagctggggacacaaggcacctgccatcaagccccagctaatttttaaaaatatttttaagtagagaanggggtttctccatgttggccagnctggtttgggaactcctggacctcaanaaattctncgcacctcaacctccgaaagtgctgggattacnggnggtgaaccacagngcctggccacacacangt

SEQ ID NO: 1937 - DNA, 748 bp, Homo sapiens
  misc_feature (1)...(748): n = A,T,C or G
cgcctgggaatactcgggaggctaaggcaggagaatcgcttgaacctgacngnntnncggttgcagtgagccgagatcgcgccacttcactccagcctgggcgaaagagcgaaactccatctcaaaaaaaaaaagggaagttgaanaananctgcaaatgtnttgttngggtaactttatgnagggttgtgnncgtaagggccattanntaaccccaggantncntttaangggaaaggnggnnaaggctgttcaaacncagngagtccatgtnnaaaatatgttttgtttccctnattcntttccccatcttttagttactaaaanatgtaactgaactgcanatccttggngaaatatntttcaacaaatntttatttgagggactgattgcanaganccacanactaanatcnntgtcgcnttcctgaaagatgaaangncccattntttgcctatcntcnttaaaggncagcngttgggggacttctgggnntggaccggnattntggcnntccnngttnaanngggggctttttttaaaaanaaaaatttcaccnccntngacctttggannagcnattagggaanggncccatttgnaaatncaanaaaaatnttgcntccnaaaaaaaaaaaaaattttagggancctggnttntnccacttgggggannagggnttttaancccnaatccttngggaactttggggaaaacccaaccttccctttttggcattttaattt

SEQ ID NO: 1938 - DNA, 640 bp, Homo sapiens
  misc_feature (1)...(640): n = A,T,C or G
ggctgtggtggagaagctgggggtccccttccaggtgctggtggccacgcacgcaggcttgtaccggaagccggtgacgggcatgtgggaccatctgcaggagcaggccaacgacggcacgcccatatccatcggggacagcatctttgtgggagacgcagccggacgcccggncaactgggccccggggcggaagaagaaagacttntcctgcgccgatcgcctgtttgccctcaaccttggcctgcccttcgccacgcctgaggagttctttctcaagtggccagcagccggcttcgagctcccagcctttgatccgaggactgtctcccgctcagggcctctctgcctccccgagtccagggccctcctgagcgccagcccggaggtggttgtcgcagtgggatttcctggggccgggaagtccacctttctcaagaagcacctcgtntcggccggatattgttcaacgtgaacagggtancgtncagtgtgcccganccgcgggcgtcccttgccgntgcttnctcttcancgccanntctggagcangcgccccacnacaaccggttttnnganangacggactcctctnatatccccgtgttcanacatggtcatttatggctacaggaancna

SEQ ID NO: 1939 - DNA, 646 bp, Homo sapiens
  misc_feature (1)...(646): n = A,T,C or G
gnnncggccngaatacatttgttcatgatgtcaagtgtctggtatgtagctaatgcttattgaacacatagtaatttattgaataattgtcatgatcactggatgagatatagccactgtggaggtaggcacaccagggttttagaggcttgggatcttgcaacaggattttcctcttgcctctccaaactgccctttgcccagatggcttcagcatctttttgcatccctgtttccttgtttggtgaacacctgtctcaacctgtctgcaaggcgtggtgagattctgcatccttggtaagcactcatgtcactccaaaacagctgtttgatgctaatagcacacatgaggtcttgcaaatttgtctgaggaactacaggacattggagagatatttatcaaacacccactacatgcctgatacttaactaggaactagaaagtgggtggtgaagacaagtggaaagtaaatgcaaacctattcccatatatgtttgncgcttagattgttcccaccaattccctcttggaattgaatgaatggacgtgtgtgtgtgcatgtgtaagnggagtgtgtatgccttgtgtggtattctgagggcaagtcangtanagggaaaggaggccanaagccagaaaaatggn

SEQ ID NO: 1940 - DNA, 704 bp, Homo sapiens
  misc_feature (1)...(704): n = A,T,C or G
ncagatgtgcagttgtgttgactctttgtctcccggtgataaacccatgtgatatnncccaaagtagataatcaaaagaattgaccaaaaaatattaaagcaaagcaaagaaacaaaaggtgatactgccagaagtgaaatttgaatggaacataaatggaattacagaggaaatagcaaagagtgggaatgttggcactgctgttgttccagtgactctagatttgctgccagacaaacttagtgaaagcattgtgacataaaggatgaacaagtgacactggcataagattttacagtaaacaaatcctgaagataatttcatgacattgaaggcaccaaggatacagtgtcagaagctgatccttaggaatataacggttcaccatggcatagaaaagatgtatccggccaggtacggtgcctcaagcttctaatcccagcactttgggaggccgaggtgggtggatcatttgaggtcaggagttcagggccagcctggccaacatggtgaaaccctgtctctacttaaaatgtaaaaaattagctgggcagtagtcgcatgcgcctgtagtcccagctctcaggagactgaggcaggaaaaatcgccaagancctgggaaggcggangttgccagtgaaccaaagatcgcaagcanttgcacttncaacctggccganagantgagaaccttgnttcaan

SEQ ID NO: 1941 - DNA, 717 bp, Homo sapiens
  misc_feature (1)...(717): n = A,T,C or G
ccncgatcgantcggcacgaccacctaaanatcattattttcaatacttaaatattagcccatnnnnnnttatcttcagatgtctataattggaagcctatatagaaatggttgatgagcctatcggttgaaccactgcagagaatagagtgatggtcttagggcatcctgtactttgcatgctcctcctggaagtaaagagtaagacagagaatagtaataatcacccattccagaactggttgcacaacatcacaaaagcttgtccagacttattagcaagttaataaaaaactagacttctttctaagtacttataatttaggctgtggggtagttctgttatgatacatttgttttaaaatattctgcttctttttaaagtgagttgtatgtgtctttgttgtagggacgtgcaatttttgccagtggcagtccttttgatccagtcactcttccaaatggacagaccctatatcctggccaaggcaacaattcctatgtgttccctggagttgctcttggtgttgtggcgtgtggattgaggcagatcacagataatattttcctcactactgctgaggttatagctcancaaggtgtcaagataaacacttgggaagaagggtcggctttatcctccttttgaataccattaagagaagtttctnttgaaaattgcagaaaaagaatgnngaaagangccttaccaagnan

SEQ ID NO: 1942 - DNA, 714 bp, Homo sapiens
  misc_feature (1)...(714): n = A,T,C or G
ccccgntcgantcggcacgaggttggaagttcctaattctttcctcggttaactgtgaaactctgnnnnnnnggaaggcctggcctcagtcatcaggccaggagaggtactggacgccgcgcacgcactcgtctgccagcgaggcccaaaggggaagcctagcggagctcagtgtggcagctgctggcctctgggccggttgtgcatctaatcatccaaaaaattcagctcaaaacctgactaaagatagtactttaaaacatgaaggcttctattcagagaacttaactgaatctagaaaattcctgaaaagtagggaaaaacagtccagcctgaccgaaataaaaggatctgtttatgaaacaacatacagtcctcctgaatgtccattctgtggaaaaatagaggagcacagtgaagatatggaaactcatgtgaaaacaaagcatgccaatcttttagacattccattggaagactgtgatcaaccactctatgattgtcctatgtgtgggctcatatgtacaaattaccatattcttcaggaacatgttgacttgcatttggaagaaaacagcttttcagcaaggcatggatagagtccagtggtctggtgatctacaattggctcancagcttcagccaggaagaagacagaaagaggagatctggaagaatcaagacaggaaattgaagaaattcagagcttgcaga

SEQ ID NO: 1943 - DNA, 718 bp, Homo sapiens
  misc_feature (1)...(718): n = A,T,C or G
ccncgntcgantcggcacgagccaaaaggcataaagataagtgagggatggagttctggaagttgtgnnnnngggnnagatttactttcaggtattggcaaaaatcacagctggagtgcagattaagcatggtaggagggtggtgattggagaaggaatggaggggaaaaaggaaaaactacaaatcatgttaaaactgtcctcattgagttttacaagtaatatactggtcttatataccctttcctcctaccgtgggaaaatatcactaacttgtaataggattaaatgaggcaatacgtaagctttttagacattttctttatagagaacattattagaagttgttggcctggcgcagtggctcgtgcctgtaatcccagcactttgggaggctgaggcaggcagatcacctgaggtcaggagttcaagaacagcctggccaacatggtgaaaccccttctttactaaaaacacaaaaaaattagtcnggcttggtggcacaagcctgtagtcccagctactcggggaggatgaggcatgagaatcgcttgaacccaggtggcagaggttgcagtgagccaagatcacgccctgcacttcacctgggcaacagaagcgagantccatctaaaaaaaaaaaaaaaaaaaattcggccctttaaaaattntagggagccgttttacgnananncccaaccttganaaananacattg

SEQ ID NO: 1944 - DNA, 715 bp, Homo sapiens
  misc_feature (1)...(715): n = A,T,C or G
ntcnantcggcacgagctgattgagaatagtncgagatgacaccacttgggtaaaaggacnnnnnnnaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaanaacttctggcatggatccagtgggcttgagaccaccctcattcagccgggatcangagccaatcccgcagaacatttgacccgagttaaaagcccttatcgcttgagcatcaagacatttatggaggagatgactcgcaaacagcctgacgtggaccgggtcaccaagacatccaaaagggaaaacatagagcctactccgcgccnttcatan

SEQ ID NO: 1945 - DNA, 1006 bp, Homo sapiens
  misc_feature (1)...(1006): n = A,T,C or G
nctannananatacnnntnaatnaantannatatcanttnaaacacnnnnatcnantattatctnatccctananantanaaatttnngggctntnttanntaatcanatcaaagggantatnnanttntanancctaacttntcntcantntctnnnnntgtantacgatttcctcannntnntntgaaaaaacnatttnngccaactgctaanntactcantcgttactgaaancaacnagtgtagcaataaatggctaatagttccattggncgtntnttactcaagcannaantacancannngtnaaaacgnngccaacatangatacctttcttggaacnatttttgnnnctnataaggcnaanagncttgtttcnaataaagntntacncctnanttnattaacttgctanttantatgaacanttcnatatgaatnaaatcnaaanaanaatctnatnnntattgatttcttcngatananncnatnttattncctttaatctattgcctnnaanttcnnctanntntncncanaagctgtccatgaatttatttcannnccacntaattnagggnnncaccnantaagcnttcntgatttnanaannattcnttgnntacnactggttnatttntnnaannaaaaatgttannactntgtntnatnaattnaaanacntnntngctaaanaagngnaacntaanaantcttaaaaaannnttnccacttaaatnanttacnttaataaantctaaattgggaaagtnaataatttcanaaanctnattnttttttaaactatccttatttaatntgnantttnaaaangnattnaacttntnacaanaanaanaaaanctnganctntaancgaatngttnctttttttcnnngataaattntcgaanaaaatantnnaanncnatanttaaaangnnanatagnnaaaactnccataatngttttcctanaaacttaaaaaatantnanttntncn

SEQ ID NO: 1946 - DNA, 701 bp, Homo sapiens
  misc_feature (1)...(701): n = A,T,C or G
ggtctcgccaaggtgtgattggaaaaattcaaaaaattgcaacctcaggcataaatggnncaaggacatcccaagcccaagtggtacgtgcctcactcagaactgacgggccgagttctatctaggtgtgtcttccagaacctgtttacggctaactggataactgagagacttgtcatttctaaagacatttaagttgctccagggatttctgaaaaaagacacaggcttcttcctagagccagccctatataacatgcccacaagggcaacagttatcacagttcatacacacctttcatgtcctgtctcactcactcctcacagccatcctaggagatacatattgttttcatcctgcatttacagaaaaagaaatgaaaacagagagcttaaataatttgccacagtaatgtcgaaactaggcctttgaaccaaggcagtctagggtaaaatatagtttcaaagtatgaataagaattggtatttgtgttatctttgagtaagaaactgtccgatatgaatcacaacgtgggtgaatgtagtattttcctgaagtgtgaaagacttaaaaaaaagaatcacattgttcagaggtgctcaatggaaagaaaaggaaatgaacaagtttgttaaaaggataaaaaataaaaaaattccatccttggtnnnnaaaaaatnctnncctctnnnnncnancn

SEQ ID NO: 1947 - DNA, 724 bp, Homo sapiens
  misc_feature (1)...(724): n = A,T,C or G
gacctcgtgatccacctgccgcggcctcccaaannnnnntctcactggcatgagccaccgtgcctggccagcaattagaattttaacactggcagttatgaataatatgaaggagaggtagatttctgagtgattctggtttaaccagctgggtggatggtggttccacgtattcaggtggcaaacaggaaaaacatgtgttcgaagaagaatggaggtaggtggtctcttaagaatggttaagaggcttgggagtcagactgcttgggtttgcatcccagctttgccgttttctggctatcaaacttgtcagctattatttgttgagtacgtactatttgatttatgaccacaggcagctgagcctcagtgttggtgcctagtgtacaagattgttaaagaataaagttattttgcaaagtgtaacccatttttagcactgacatagcactgacagtagctgctgatctcattatgggctaaaataagacaatattcaaaggtcagagatatcttacccagaatctggntggaggctgggantttcangattttggttccaggaanttagacngaaggaaccccagangggggncaggcctcaatttaagggttggaaggtngtggggggtaagggaaagccaggaccttggntatnaaanttatttgggaaatcaattgggcctttttaaaanccaagggggttttattgtcacgggggatn

SEQ ID NO: 1948 - DNA, 1000 bp, Homo sapiens
  misc_feature (1)...(1000): n = A,T,C or G
annnnnnnntnnnnnnnntnntnnnnnnnannannntannnnanntacnanatnantntanacnannnntananntnnnnnnttnnnanatcnnnataantatggggcannannannttnanannaccntnnnnnggggntntatcattnnntttgaaaanccnatantnaatacntnaggagnaattcncagcangnattgaagaaaangtancaggctgcaccntntnncanatccttncgtgcnatcatctccangnantaattgaaagggccattcangaaacagcaccagggngctacaaatttacnggntncactnggtgatntgatcttntcatncancacaatggacanaangtctaaggaacgtccttgtggattcctttgggntcctgcttctntttacagcctatggaggtcttgcaagagcctgcanagcatccttgtacagctaggagggcctgggtgatnacancgcctcagcaccctctatggaggcatgctcctgtnctccatgttcctcccaccgctcctcatcgaagaggctgggcttgnaaangggaccaatcaatcctcttccaatgtgtggntacgtgngacttcntccgtgggcaaantttnttcgccagcntgggnanaanttttgnantcccaccttcccataacttgcttgnggaactnngngggcctgcncccnactttgtgggtctggcaacagnttgccacattacccttaacngaattnaacnngngnaaaaccacacnattgcctgaaaaaanggccggggaaaaaaccgttggccaaaacaaacaattggatggaaaaccaagntntttntngggcaatctttacttcntcaaaaanatncaaatcaatncccgggtggtgtggggggnaaacntttgaaactnananncnttggtaattttggcccanaattccaancnaaaaanaaaccctttcanaaaanaacaancttcanntatcttgttgggg

SEQ ID NO: 1949 - DNA, 713 bp, Homo sapiens
  misc_feature (1)...(713): n = A,T,C or G
ccncgaatcgtnttactctggaaagtagtagcagcacttcaaggacataggggttgctcatgtcannnnnnnccgnttgtattggaagaatcataataacaaatatttaagttggtaaattactaggtaaacaggttggtggattttttgttatttttgagaatactttttagtttgattctttgaatgaatttacataacagctttcctgtcaagtcagtaatttcacccatctttaaaaaacaagtaccaaaagagtttcttaacaccatatactcctctagcagctgctgcctagtttctctcctccacaacagagctccttaaaagaatgcagttccattttcttttttccattctctcttgaatccactcctccagtgatggatgagattgcaaatgtttgactctgcctatcgtattactcagtctcggcaacatttctttatttagcttctgggataccattctagcctggatgtagtcctatcgttgtgattactccagtcttcgatgctgtttcttcttcttcaccctgacctcgggatgagataacaaattgtaataaagtaacttctctttttaaaaaaaaaaannnnnnnnnnaaannnngannnnnnnnnnnnntnnnnnncnnnnnnnnnnnnnnnnnnnnnnnnnnnnnntnnnnnnnnnnnnnnnnnnnnnnnnnnnnnnnnnnnncncctcncncn

SEQ ID NO: 1950 - DNA, 700 bp, Homo sapiens
  misc_feature (1)...(700): n = A,T,C or G
ccncgntcgantcggcacgaggcttgattgtggcttgaagtttgaaaggaagtgcctgtttgnnnnnnnaacaccaattggactaacagctgtcctctgtattaaggccatctttagcttgtcttgcaaatactttccttgttcactaatcccttctccccaccctgcttcctttagacccatgttaatctattacctgggagcagctctagattcttgagttggtaatgactaatttctccgttgctctcatcctgttgagtttaataggctctcttttttcttactgatgttttcatgatgagatttctaataagttatttgggagctatcagaatagaaactaataaatattatctatctattagctgtcagaataaaagcttactgagggtcctgaactgtgaggccactgaaggcaggggtttgggtctgatttatctgtgtttgcctagagctttaacagagcctgacacttgtaactcttaaaaatatgctttaaaataaatctaaactcaggcatggtggctcatgccagtgatcccaacactttggaaggctgaggtgggaggaaggcctgancctaggaactcaaggtgagaagtgactatgattgngtcactgcactccacctgggtaacagagtggagaccctgctnttttanaaaaaananannntntnaaaaaaaaccccncccnn

SEQ ID NO: 1951 - DNA, 710 bp, Homo sapiens
  misc_feature (1)...(710): n = A,T,C or G
ccncgntcgnaancccaaatcaaagtggtgatagtaaatatcattgccttggttctcacctcannnnncccgtttcaccattaagtgtgatatagcttagttttttataaatacttgggagtgaatttttaactgggtcatagaggattgttggatttcagcaagtagaaatcagtggaaattagttctccagacacagggaagagacactagtagtaaaacaaatggtctcctttggctatagattaaagggagatagtggaacacacacatttgtcatgataaccctggctcaaagatagaagattaaaaaaagttatgatggggccaaatcatggagataagacagttgggaataactcttctttcagcgctaggaggagaatggagccaacatcaacagaattagagaagtcatcaagaaaagttagttatgtgaaggaatgcctcttgtggcaattttttaaaaattgcattttatgatttggaactcacccgtcttaaaataattggctcttagaaatgttgtactgctacttagcagaaaattcagggcaaaagggtaaatgtgggtatcatttacatgttggangacattgtatganaagtttgaagaaatgtttggtataaaagataaatttaattctgcttctttggttctgngacaatgggaaatttgtttaatatctttgggncnttcttttcaccan

SEQ ID NO: 1952 - DNA, 764 bp, Homo sapiens
  misc_feature (1)...(764): n = A,T,C or G
ccncgntcctangtgctataaattcttctgacttgctgtggctaatttattaatttaaaaagtannnnnannctttcttaggcctccttgaatctagtcactctagagatagaatacacaatcttgtcctgatgtttttacttgcaactcacaatcttgtttggtggtttagttgcaggtttcagagattagaccgtatatatctaaatgctgggatcatgcctaatccacaactaaatatcaaagcacttctctttggcctcttttcaagctgaaggcctgctgacccagggtgataagatcactgctgatggacttcaggaggtgtttgagaccgatgtctttggccattttatcctggtaaagaagctgtgggcttaataagctaatatttggtgtgataagttcctgtaaagctctgggcacagggcattattatagttgagcagccagttaactgatttaatctcatgtttgagttttcttggattgcatttgccttgttaattggngaaccatggaaaaacttctgggaagctttcctaagtaaganttttttctttttaataaaatggancttaaataagttttttggaatttaacaggaaattaactggccaaaagaataagtaccaagaanactttttttggtnttgccccctacccccccangtttttccccntaattaattaaaccattttccncattgggtatgnatgccattttggccgaaaataggatggaaatccaatttcttgcttnn

SEQ ID NO: 1953 - DNA, 736 bp, Homo sapiens
  misc_feature (1)...(736): n = A,T,C or G
ccncgntcccccccgcgtctcccgggagcgtcgccgccacctgcacgcgtctggcacacaaacntnnnnnnntccccttagtttctggaagagaaaaaggaaaagccaccgagaggcctgaccctgaggggtcggggggagatgcgggcgcgtagtagagggaagcgactgaggagcggggactgggcagcatttgaatggatgcgggtgccgctggcacccgggaagacgcctgggagccggcgctggggagccgggcatgggctgggatgtgtttggattccaatctgggcctgacaccagttcagtgacctcgggaagttccccaaccctgcgggcctgtttcctncctctgaagtggcgacagtaatagaaccgacctcgtaggctcatcgggaggtcctgatgggagaacccatgcaacttgccaccacagagccaggcccgcggcgactggctcctggtgggtattaaagacgagtcgggaaagaagagcaggctcaatcaaaccttcaattggccccgaaagacattttgattgaaaacctcattgaaaaacttttgagccanaaaacccaaccaactttnaaaaccccannatnccttgaccattcagccacttgngtgnaaaaaaataaaaatgnttngttggttttaaccttggnnnananggnnntcgnnacntttnnaaanantntnnaaaaaaatnttnnganaanatttttcttctttttnn

SEQ ID NO: 1954 - DNA, 698 bp, Homo sapiens
  misc_feature (1)...(698): n = A,T,C or G
gaagcttancaccttgatgcctgacaatagaaactatccaaaataaggcacagnnngaaagtggaaaaaaaggcaaaaaggaaaacagagcacagataatgtgagacaaggtcagatagtctttatgtatgtgtaattggagtccccaggagatgtgagaggaaaaagagttgaaacaatcatagacaaaatatttccacgtttgatgaaaactatattagttgtgtattgctacctaacaagttattccaaaaatttagtggcttaaacaaaacatccattatctcccagtttctctgcgtggctcagctgggccctctggttcagggactcttcacacggctgcaatcaaggtatcagctgaggctgcagtgatctcagggcttgactgagggagactgctttcaggctcactcgtggttattggcaggatttagttccttgtgggttgttggcctgacggcctcggcttcttcattggctgttggccagaggctgcccacaattctggatcacataggcttctccgtagggcagctcacaacatggcaagctaacttcattagaatgaacaagcaagaagcgccaaaaaaaaaaaaaaaaaaaactcccccctttaaaanatataggggngtccttttncnnaaatccccncttgaaaanaaccccttgggggaatttgggacacccccntnttn

SEQ ID NO: 1955 - DNA, 708 bp, Homo sapiens
  misc_feature (1)...(708): n = A,T,C or G
gtagcacnncnacagcaccttctcaaggtggaaaatccatggagtttagttactgttgatctgatggggccttttcatacaagcaacagaagtcatgtatatgctataatcatgacagatttgttcaccaaatggattgtgattttgcctctatgtgatgtttcagcatcagaagtttctaaagctattatcaatatatttttcttatatggacctcctcagaaaataataatggaccaaagagatgaattcattcaacagatcaatattgaactgtacagattgtttggcataaagcaaattgtaatttctcacacctctggaactgttaacccaacggaaaggtcacctaacacaantcaaagcatttctctccaaacactgtgctgaccacccaacaattggggatggatcacctatcagctggttcatttgccttcaaatggtaactcacttgggaacctacttaaaaaataccaccatatttttccaaaatggtttaagtccgaaaancccttatatggcctggaganntttaagaatagtctttcaatgaaagtnggaatgggnggataaataaccaanntattggttttngccaaaaaatttctaanaaggccaatttaaaaggaaacctggataaaantaatngggaaaaataannaacaaccttncncntggggcccanaatgggaanaacaancaant

SEQ ID NO: 1956 - DNA, 707 bp, Homo sapiens
  misc_feature (1)...(707): n = A,T,C or G
ccnncgtatcgccctgcanattcttcttggacatcattaatggagattccactgctgtggcattaancnnnnccaagactttaaagccacagagatcatagagccttccaagcaggataagccactcatagaaaaattagcggagatttatgtcaactcctccttctacaaagagacaaaagctgaattacatcaactttccgggggtagagaagaagctcttcatacatgaatacatcagcggatactacagagtgtcatcttatttccttggaaaactgttatctgatttattacccatgaggatgttaccaagtattatatttacctgtatagtgtacttcatgttaggattgaagccaaaggcagatgccttcttcgttatgatgtttacccttatgatggtggcttattcagccagttccatggcactggccatagcagcaggtcagagtgtggtttctgtagcaacacttctcatgaccatctgttttgngtttatgatgattttttcaggtctggtggtcaatctcacaaccattgcatcttggctgcatggcttcagtacttcagcattccacgatatggatttaccggctttgcagcataatgaatttttgggacaaaacttctgcccaggactcaatgcacaggaaacaatccttgtaactatgcacatgtactggcgaanaatatttggtaaacag

SEQ ID NO: 1957 - DNA, 697 bp, Homo sapiens
  misc_feature (1)...(697): n = A,T,C or G
gagaaagttgtgcaactgaaaatcctttcaaacaacagctacaaaagagattggtcagttaggacaggaatagaaagtggaaacttagaagactggctactccttgtgtatgattgctggggtgagtctgtgctgagaactttttacaaagggtgtcctttgctgatatgagaggggggtgtcaaacttttgagtgatcactgtgggtcctcagcttagacatcttctctggcccaagatggcaccccttgctctctttccatgggacacagggaccttgccatccttccatcttataagccttctgtcatgatttttacttcatcctagataaccttaatttgggccaggtctccaggttcctccactttcttctgtcccatccatacccctcaccaatcctctgtaaattccttttccaggattttactggagaaccaacagaagaaaacaggctggggaataaacaaacatgggggaggttattgtaagttaaacatacacttttgannatccccctagnccattttncttgantaattataagaaataaaccnctnggtaattnacnngggttaataaagggtcccatggnagaaaagccttttaattccttttttntgggaaaanccaaagaaaaanccaccctgccccttccctttaagtccttaaanggggggngaaaacttttatgggg

SEQ ID NO: 1958 - DNA, 1101 bp, Homo sapiens
  misc_feature (1)...(1101): n = A,T,C or G
ttttggantttggnnggctncgtgnaaacnnttggaaaanccccgnnctttntggaanggcacatnnngnaanaattggagggnccggnanncctttttnattctccgtttttaccccccctgngnccnaaggtanttnaangggaccctntttcaagatcgagccttnnctnntttncccngaannnccccaangagnantcangtnggcaananggttntnccacacacnnactggtcnngcgngtnannngcnnnncancananngnccttagcccctatccncngnnncccctncttnntncacnaccgcnncacttnnganntcccnntcnggcngngcacacacagtgaaangganaactagtgannacagccccaggtgcccttacntangannagantgaanattantcnncnntanncaanaannaannctctgggannggngctgaaacntnanacncganccggngtntnganatngcccagaagaanggnntcccnnaacnngcaacnacanaaannnaatggangnncntntcacnctantaaataggaaaatggcctattngctnttgggncccnctgatcnagnaantggnaactnaancccanctctctggaacggggaaaaaaaanctntctcgtaaaagggagantccccatganacnatntntctgnnaagcnttntcgacaacntnaggngtagattagtacaagacngggagatngnctctntncatgnaacancntggggnaanccatgtncctntcctnggtgaacnanagngngggntagccnctanntcagnannggtcgcncnncncaancgggggctccnaatgncatgtgggtnncgcntaanngtcgggnnataatnnctacactatacntngtganatantcntcnctagntncagcttcnnntacganccatnactcaaaanngccgctccccntncacnnctangantaaganggtatncnaganatcnatanntctgactgggatncgnntntcatngnatcttntnagtaggnaggnnnctatnatatcngntacnaatcccngatntctnncanntatggagancg

SEQ ID NO: 1959 - DNA, 596 bp, Homo sapiens
  misc_feature (1)...(596): n = A,T,C or G
acntattggaacncttgttctttttgcaggatcccatccgattcgcatgtggtgcacaggtcggatggtaaatttcagatctttgcctatntagggaaagttcctgtggttgtgagttacagacctgccaggggagtcctgcngncngttaccctgtnnttggtggnctgctnttccnnntntttgnnngntggggggcgtnccccctttgtgggggnatgatgtctnttnagatggctggctggctacaccgtgcacatttctgtctaagtgccttaagagaggatcgccaatccacatgcttttcagggaaatctgtgtgatagagaactggtacaggctttttgtgacgctcctctcattatgacacgtggtaaatcttgaaccatgagacagncattctgaaggagtgtntancaacgaggngcaaacttgccaacgacacataatgtgctgttccaccccatgncagcctgtcaagatgtgtnaancaacatncntgngtgngattctgaaaaagacttacctgactttgactgcaacttgctaccacggtctgactgntnnacctntnagnntttgacatggagaggggn

SEQ ID NO: 1960 - DNA, 777 bp, Homo sapiens
  misc_feature (1)...(777): n = A,T,C or G
nanncctnttacaaactattgttctttttgcaggatcccatncgattcgaattcggcacgaggtcactttactctccatccggaccgcttcctttctcgccgcgaggctcggggttggggggggaccagattggagccgcgggctaactgggatccgtcccatttccctgggcttgacgttctctgaatttttagctaatgtggaaagttacatttatttgcatttgtttatcgcttgctcacataggtctgtgtcccgaagcttggcagatgagcgaacttagccagcacacccccggccgtgaagcagggaggtgaagcggggagagcaacgagccccacccgggtcttgccagctggacgttcttgtggggcagcgttgagcagcggttaggagtgccgtggactttggattcaaacagccccagctcttctgcttgctagctgggtgactttgggcaaattaacatctcgaaaatctgtttcctcattcctaaaatgcgggtctgaaagtgatcatgcctgtaaagccatctcatatccatggttctagaagcatggtgagcacctcaatttgaataatcagtgccatgctttagctacctcttgactcactcgtttgtggcaggaaatgttcccaaattaatcagaagaattcaatgactaagaggatgtaatagtatatagcgcaggcactggaatcaacntctgctgtgtgatcttggacaagctgcttctgttccgtttctcttatctggggcaatacctgtctgaann

SEQ ID NO: 1961 - DNA, 1016 bp, Homo sapiens
  misc_feature (1)...(1016): n = A,T,C or G
ggnnnnnnnttttttnnnnnnnnncgcnntttaananntggggnaaaaaaaancccccttttttggcccaagaaacttnnccnctgggttttctttttttttgggcccanggggnaaaccccccnatccggggantttccggaaaatttncggggccnaccggaaggnaaacccatgggaaccttcccactgggttaagnccctttgggnactttttctttgggggggcctnccaggggcgggaatncccttcccccaaccctttcaaggcncttccctgggccnttaggnntnggggggggnttncnnggggncttgggtgggcccacccaacaaccctggggcntaaattttttgggnttttttttttttttngggnggggaggananngggttttgcnngngttggnccnngnttggnnttnnnnntnntggggttgggggggnnnnaattaacccgcaggctctcaaagtgctgggattacanggcatgagcccctgcacttggccgacattcaatttttatgaataaaaactacattggaaactaaggnggtatggtttaaaatgtgtcagcatttgnagaacgatttaccctttcaaaaggggagagcagggataattttactttttttgntttaaacaatctaatactggtagtaacttttaaaaaaatattcttaatagattggctactattgcaggggtattatttgtatgnctggctatattcattcagttaatcanggagctgaaattatgggaggtactatgtggagggagcagggcatttttctgacnaaatgctttatgggtggaatacatttatgaaagtaagttaatggttcttctgnccaaaatanggnagaagttcaaacccatattttggagtctcgcatcaagaaataaggggatggagnggccactggggaatataatgcagaaatgggcttaaggaaaaaagaagaagggggaatgaaatggtaagtttggcctngaggcttatacactatggg

SEQ ID NO: 1962 - DNA, 1259 bp, Homo sapiens
  misc_feature (1)...(1259): n = A,T,C or G
anggggngnnnnnnncnnnnnttttttttttggnaaaaaaaaaanccccccnttttttttggggaaaaaaaaanaaaaaacccccnccgnncccttgnngggtttttttntttgtttnatnngggggaaaaaggcgncccanaatccccngcaaatttncccccacanatttcttccggggggtttaanccnnngngnnggggggggggaaanaaactttngggtgttgnggnctttttcaanaaaaaaaccnccggggngttnttttttgttgngtnnccccccccttncaaaagggggaacgcncnaaaanctgnnggngnggggaaaaaancncgatngngngcgccccccggnttgnttttcccccaatanangggggcncannaaaaaccncaangcnnnggggnaaaccntcnacncaattggccgngnnaattggtnctggggnngttntntgggggcgnanaacnagngnnttantttttttnnnccaaaaaaaatttccccaanngccaacctncnctttgggaacnnntnantnttnanncaacttctttgggtggaaanctttnnanaannggttccggggagggacatttggggnaaatggaatnttaccagccttgnaacancattttctnnntntgggccantctttcnntnnnccaaaaccncccaatnctnnncganttttnaaaaccntgntgggcaaatcnncagtngaaaaggaaccntaggttcggantattaccaccttcaangttttnaaaatncccaaaatnaaccccatttccttgggggttaaattaaatcccaagggnccaggaatntttttactttttngccaaccggnaantcnanntantttcnagccaggncttcttttaacttatttaacccttcccaaggncnangggangcctggnnggtggttnctgggactttntttttnaacnaaagggccttgtngccccccctggatngnttnttattnccgggaanccangggttaattaaaaancngaaattggattaaaaaatggntnggtctccttttgggcttggnaaattgcccnancaccncaangggnggggccantttttnttggntcaantttcccttcaagagaaaaatttggacctnccaaaaacnagncgtttnaaatttttttgcnaangaaacnaaaaannnccattgaangcctttgggnctcctacnnacnnactaccannntggggaaggttacccttttngg

SEQ ID NO: 1963 - DNA, 1088 bp, Homo sapiens
  misc_feature (1)...(1088): n = A,T,C or G
gngcacgaaaangganacgaggggcgngngnnnagaaggagggngggaangcngcnnngnggaggggaggaggnnggggngncngangnngcnannnnnnngagntggaaccgtaagcnaacncgngcnnntgnaggaggncnccnaacgcgccccnngncggnanggaggggccaagcnnaaanacntaggaaggtttntttngtncncanaaangaanggcngnngnaaagggggggggtgtatngccccaaancntaagggagaaggccttnaggaaaggggagagangnngncaatgancaagaaaggnnccgcnccnanaagcccgagggannanagggggggaaaaaaagantnnnggacagggnangacagggggnaaanaannaaaggngaggaaaannnccnancntggnnggcnttcnaagannggtggnnacccgtangnctggaaggggcctncanacttggnnggncntcccaactggnaangcnanggnaannccaccngtnccnanaaanaaccngganggncgggtggcccnaannnnnncnngncagnggagagccacaannctaannggggaacnaagggaananntcggcactgtctgtggnnggganggnggaaantnccnntgggacagngggagggnccccncaattcnnaanagggcnggggnccanaaaaaaaaaggtnnggcntnggagancaacaaantgggccatcaccancccngggaaagaccccanccnagncnnggggaaaggcacnaaagnaaggganggaatgccctanggagggcccangnangtacccaaaaactnaggccngggggcnaataatngagggggagaacccccccanannncttccaagtnnaagnaaaaaaagaannggcnntcnaantcccaanganggggcgaccagagaaaatttggcccnagancttcaccggagaaacancgggggaaaancggggntgcgggnanaaagaagttaaaaaacnaacaggggnnnggggcncggggggggannacaccatanantgccgggncnanaaggggagggcaagggcnagggg

SEQ ID NO: 1964 - DNA, 762 bp, Homo sapiens
  misc_feature (1)...(762): n = A,T,C or G
attctatcctttaactcttgtctttttgcaggatccctcgattcnattngggcnngggatgcccgggccttttggggggccttttngnccttttngttanannnnncccgggggggggggnantgnagggttcctnggggggccctntntcctttctaanttntnntgaannccttgnaaangccaaaantcacagggttanaaangacttggnntgntttgcggcccagtccacccaacntgccnttttttttganaaacagttgaagcctttaacaaactcttgcttgaaggcagaaagtccacntgtnttcccccaaccatggnnnncncccattgttgatgccnnttgtgacgttattggagcgccagcttgtgatttttgaaggaaccgacatgttgggaaaaaaccnaccagaagctgtgaaaattcatgctgaaccttttggcaacagcgccgattcatggccgaggcttgcagacacttaccggattgaatgctgagaggatcctggcaggttttcaacccanatgaagaaatgaattgaaaatctgcaagaattgaattcaaaatgcgattgctattggggcagcaaanggtgccccaagttcaattcagacnagangagatnttgagaaaattcaacccggatttttaactggcccttttcccgtnaaattgggaaccttncttcttgttaaagcaaggccagaagctttnantaacttttccaaaannaaaccntttnanaaatntntttt

SEQ ID NO: 1965 - DNA, 714 bp, Homo sapiens
  misc_feature (1)...(714): n = A,T,C or G
ncnntcnantcggcgcggtgagtggtgagactgccttgggcgggttaccgggcatgactcttcnnnnnccccnnagacccccccttccccccgaactcctccagcccgcagagttctatctccaggtggaccgcttcagcctgctgcccacggagcagccccggctacgggtgcctggttggtaagtgatgcctccgcccaggagccctgctctgtctgggtgagcatagcccctctgcagctggagggtagaacaaggaagcctgaggtagagctgggagggagcatgggtagccttggatggggttggggtccttgttagctcttccccagacaccatacccctttcaggaacccccaaagaggcatcgtgatggttctgccttccagtatgagtatgagccaccctgcacgtccctctgtgctcgggtccaagctgccaggcttcctccccagctcatggcctgggccttgcactttctgatggatgcacagccagggtctgagccaactccgatgtgagacgtcacgcaggacagataccgctccacactctgctttctttgagtttttttaataaaaataatctcatgcggccnannaaaaaatnnaaannnntttnatnnnaaannnaaanccctttnaaanntnaggggggngnttttttccgtcaccccccnnatntaaaaaanncttttggggggtgtgggnnnn

SEQ ID NO: 1966 - DNA, 691 bp, Homo sapiens
  misc_feature (1)...(691): n = A,T,C or G
gaggctccagacagctcttctgtctttcaccaggtccaaacaccagcannnnnctcccatgaaatatcccctttattccatctcaaatccttacctatcaactccttgcccagagaacctggaataacatatttacttctagtccttttcaatgcattttccccttgggagaggtgagggggtggtgtgtgtgtgtacatgaaagaaaatcagacagattgaccatctttgacggtaactcaaagggataaatagatatagttaaccgataaaaaaacaacaggtgaaaccatgatatttcatgtcttgaccagattataagcactcttaggataaaagcaaggtgataacccactttgttcatggtgtattgaagtatctttcttagtggacactcccatttcaccccctctcatcacctgttctgaaatacatgctgggaagttgacaaacaagattctggtaatttggagaagacagcggttcaaataaaggagaaaatttctctgtanttctgggaaaactgaaaatattcagtagataagccaaatgttcaatttcatgttgctcttatagttataggtattctaagaaacccatattaatccatcagaaaattcaacatcaagtttatcaacctgtttaattaatcaaccttatcattcaatggnacatcacctgagatagtaaa

SEQ ID NO: 1967 - DNA, 972 bp, Homo sapiens
  misc_feature (1)...(972): n = A,T,C or G
tnnacgnnantnntnatnncannnanntntnnnnatnnnnnnnnnnntannnntgtnannnntantntanntnnatctnnntnatcnntnnattnnanncntnntctcactatancannnggnggntnatntanntatatanaaacnnntattggggaanttntctctttatnantcccnnctcnaaantcnnangaccnnanntannantntgtntaacaactacataggnancnnactnacgngnnncaatccntnnanatcangncngncncaccactgncncttgtacaacctttgcagtnntncccggtatgtggtatgtggtctccgccnatgattgggcnnctggtcaggctggnatatncaaatancacccattggnnatntgctngacccctggaggggnaanccaggaaangaaactcacggncnnttgtgatcatatgttcntncnanttgggaagactaatcttggatatgnccaaatatntccnangattcntctgtcnaaattatncctngggatctgacccatttcctgnaaaaggggcgagcctgggttttgaagttcaaactagagtttnaatncacatnatttnncnctaatnccactgtaacnnctgngnaccttcatnctctgaagcnttnanntncttngttgtgnaaagcctgctaactactcgatnantantggnacatanaangccncnnggangagntttttnctntgagtcagctttggnttnntgaacanctttcanttnngcnattcncctnaaacgtttatggcgctnannantttcatnaaanttatatgggccaanncncnagtggnntnacaaccttgtaatncncnaatcanttatngtgaaggnccnaaaacngncttgantcaaacttgngggntngnaaactttgnaaaaantnnntntaacctaactnntgagtaaacccttttnntnttnatnn

SEQ ID NO: 1968 - DNA, 685 bp, Homo sapiens
  misc_feature (1)...(685): n = A,T,C or G
gtggctcgcgcctgtaatcccagcactttggtaggctgaggccaggagtttgagaccagcctgggcaacatggtgaaaccctgtccttacaaaaaagttaaaaattagccgggatgtgataccttgtgcctgtggtcccagctacgtgggaagctgcggtggaaggattgcttgagcctgggagatcgaagcttcagtgaaccgtaattgcaccactcccttccaggctggaggacagagcaagaccccgtctctgaaaataaaaaagggcctgctttaggtggctcacacttctaatctcaacactttgggaggctaagcaagaaaactgcttgaacgcangagttcacgatcagcctgggcaacatagtgagaccccatctccacaaaaattaaaaaatcagnctggcatggtggcccacgcctgtatgaggtgaggtgggaggattgactgaancccagggangnttgaggctatatgtgaaccntgttcacaccanttgcactttccanccttgggcaaacaganccgaagaacctgtcttgaaaacaaaaaaaanaaagcanttcccgntgggaanggaaattngcnttcannaaaagnaaaagaccgtcggggaagaatccanatgggtttggtaaaagaaaaaaatgtggncnnncanngttacnnnnaaacctangg

SEQ ID NO: 1969 - DNA, 1376 bp, Homo sapiens
  misc_feature (1)...(1376): n = A,T,C or G
acnacnaccnaaatcntctaanaacttacnaanatcnttnaaatctntacanaannnantttatntaanttctanatcattaacactanattacnaaatttcnaaaacnctctctctatananaatnattttaanntttntanttccaanngggggtattcnaccatctaaatntctaantnantatcatattcggggggncaaanaaataattatcttnactaanacacacctatanttatanaaatctntnacannncnatnacncntanacnntcataacnnattctatatacatatacantanctaatntaatacntacattaatnatnnttncncnttacnttcaaanntatttannactttaaatanncatcatcantactcacncnttctactcattctanacnatctannccnnctttaaatnatttattnnncttaccattntatataantntnttnannnnatntattaatanctatttatntnnacaaaaanaatctctatttanannttaaatnattngntattanacttnantcnnaaancncnttttttntatttaanctaacncnanncncttcntatncattnataatatnnatcnanctctntncacaatataaatatncttttacannntattnatatntannttatnantttaatcnnnnntctntcnttntacnantcacnananactncattcttaactntancactattatntattatcaatntanantnctcananatacaatnatnnttattnacatanctaantaaatnataacaaantcatatatnttatatctncatcttaaaancccctantactctatataatncttgtctncatntatactttantctcatcnctcataatgcaanatctctatattatntntatatatacntctaccctactatangcttacnatattcntantatntatttntatantacttaantctangtacatatctctatatacnncctatnnatatatactctcatcaattactcatcttactntatatcncatntntataaaaaactcacatattacncncttccnctatatatananatatatcctcgtctatcatanatatctattanctacctttaccttncatatnancctctcatctctcncnctntaacntanatcatcngccatanttttatantnnaaaaactaaatacactattcaaatttatnattnanactacttatatactattacctactntnaacactttnnacacctctacatntatntaaattcaatataccctatacnantatatacttatcncntcaacttatntttntctactattnntcacttncaaacantttttnc

SEQ ID NO: 1970 - DNA, 618 bp, Homo sapiens
  misc_feature (1)...(618): n = A,T,C or G
agnnnnnnaatatttgaaaagagtaattggtttggaaggagacaaaatcctcaccactagtccatcagatttctttaaaagccatagttatactatagtgataaaaacctgtgctacacatccatttctcagcaacggctcctaggataatcaatcatggcatactgctaatgccttgattgcagctgatatggaggaaatatgtttactcttttgctaaagtgaagttcactgcggaggtgccaatgggtcatgtttggttagaaggtgacaatctacagaattctacagattccaggtgctatggacctattccatatggactaataagaggacgaatcttctttaagatttggcctctgagtgattttggatttttacgtgccagccctaatggccacagattttctgatgattagtaagcatttattcttttgacttgattattgnctccttttcatgtgaatttattactcccgttgaaaccgtgtacttaccaataaactatttgctnttccnaanaaannannnnnnnnnnnnnnnnnnnaannnaaaaannnnnnnnnnnnnnnnnnnnggnnnnnnccccccccccccccttaaaaaanggggggngtn

SEQ ID NO: 1971 - DNA, 796 bp, Homo sapiens
  misc_feature (1)...(796): n = A,T,C or G
ntgttcgaattctgnacnaagaattcaagncagcacgtatgtagcagatgatganntctaanctggatgatacntaatgangtcagatttgnaatctaacttngnggctgtgnntagggtgcaaggagnacttccangacctatactcnaggcgccctgggtnnantaangnaaacnnnctncntaaggntggcccccacgtggggaggtggagttncngaattattctgtgcgctaccggccgggcctagacctgtgctgagagactgagtctgcatgtgcaccggtggcaanaanggggnngatcgtggccncacntggngctgcaagtcttccatgacccttttgcttgttccgcatcctggaggcggcaaaagggtgaaatccgcattgatggcctcaatgtggcagacattcgggcctccattgacctgcgctcctcanctgaccattcatcccgcaggacccccatccntgtttctcggggggaccccttgccgccattgaaaccttggaaccccttttggcagcnttcttcagaagggaaggaacanttttgggtgggggctttttgggancnttnntcccccaccctngccaccaaccgtttttgttgaangccttccccaaaccccgggcaaaggcccctggggatncttttcccaaaatggccttcaaaaaaangggcccgggggggaagnaaatnctttcaaaccgttngggggncccaaaaaaggccaancnttccgtgggtggcccttgggcccccnanacccctttgttttccccaaaanaa

SEQ ID NO: 1972 - DNA, 681 bp, Homo sapiens
  misc_feature (1)...(681): n = A,T,C or G
ttatcgaataagacacgagggaggatgttgncannnnctantcgggaggctgacgcaggagaatcgcttgaacctgggaggcagaggttgcagtgagctgagaccatgccactgtactccagcctgggcaatagagcgagattctgtctcccaaaaaaacaaaaaacaacaacaaaacttgctaccacccagggattttctgctatttaaaaggtgaatttcttttctggtactaaactgtagctgcttaacttagtaaaggctgtgtttggccaggcctgtgccagaggctcacctggagtgctccacccactggcaggcaagtcctattcctattcacccaggatccccaaggctgggctgggatataaatgttgggataggaaagaaatatttcctttttagaggaaagcaagaagaaacattgcctgaaaggtgattttctagtcatttccaattagtacagaaatgttactgcctctgggtgcagtggttcacgcctgtaatcccagcactgtgggcggatcacttgagcccaggagttttgagaaccaacctgggccaagatggcgagaccccatctttcaaaaaaaatttaaaaattacctggggcattgggggcacacacctttattctcaacttcttcaggtggctgaggtgggaaggatncctttgaccct

SEQ ID NO: 1973 - DNA, 666 bp, Homo sapiens
  misc_feature (1)...(666): n = A,T,C or G
tttcattcgcacgaggcagactccggttaaaagcgcttaatgcaacattcagagtgaaaaacccagacaagagatttactgaccttaagcactatagtgatgaactgcagtctgtcatctcacatcttcttcgagtcagagctagagtagcagatcgactctatggtgtatataaagtacatgggaattatggtcgagttttcagtgaatggagtgccatagaaaaagaaatgggtgatggactgcagagtgctggtcatcatatggatgtgtatgcatcttctattgatgatattttggaagatgaagaacattatgcagatcagttaaaagagtatcttttttatgcagaagcattgcgggctgtgtgcaggaaacatgaacttatgcagtatgacttggagatggctgctcaggacttagcatccaagaacagcagtgtgaggaactggtaactgggactgtgagaacattctctttgaagggaatgactaccaagctctttggtcaagaaactccagagcagagagaaccagaataaaggtgctagaagaacaaataaatgaaggagaacaacagctaaagtctaaaaatctggangcagagaatttgtgaaaaacgcatgggctgatattgaacgcttcaaagaacaaaagaacccgagac

SEQ ID NO: 1974 - DNA, 671 bp, Homo sapiens
  misc_feature (1)...(671): n = A,T,C or G
tttcgatncgcacgaggttctcccttatctgatgctcactgtggccttgggcagcctggcatcgagaattctcagcatgttcactcttgagttctgtgcctgcatcacacagcaatggaacagtcccaaaagattcttaagggtggggaaaggcactaagaaaagatgaacctgcagtccctgttataccatctggtctaattgatactactgttgtcaagcaaaaggagctctctccctgaggcactggaagccaatattttgacaccaggtttttgagaaagaaaagttttttattgtaagttgactcacaagatgagtcaagctcaaatctgtctccctgtgctggttttaaggcagtaatttaattataaaacgtttaggaggtggattctggggttctcaggtgataggtagaaggaaaggagaggtctggaaagtcttcaggcatgcacagttctcttcatgtctcctcatgcatcatgcgcacatttagtgggagtttgaaacatggtgaggaaattcangctgtgacatcagcatgcttggtctgtgcaaactccatttggccatattggtttcaaccaattttggccagttttgtaganggagttttgagcatttcaagaaagttatttcttatctgctggtctgnaaatcataatctttgn

SEQ ID NO: 1975 - DNA, 668 bp, Homo sapiens
  misc_feature (1)...(668): n = A,T,C or G
ntncgaatcgnacgaggtattaaataagatgtctttaaacagaaacacacatatatgtattgattgattaatgaggctctcaggaacctgactctgtgtttcccctaggagcagtgtttcagtattcactaatcgagtgttcatggtgactttatagaaccactgcaaatagtgagaattaactatacatatatgtttctgtgtgtacgcacatgtgtgtgtatgcatacttgtctctaaacatatgggattatactctgctgctgttttgctctttatgtcattatgtatactatataagtatatttttacattataatatgtgctatatattaataaatttttttaaatgtattaatatctgctcttactgagagagttttcagcctgctgaatagtcagttttacagtactagctaaaccttcttttcttttttttttgagatggagtctcactctgtnttccaggctggagtgcagtggtgtgatcttggctcactgcagcctccgcctcccgagttcaaacaattctcctgcctcagcctccctacagctgggatnacaggcgcgtgccaccacgcccagctaatttttgnacttttagtaaaanatggngtttcaccatgttggccaggctgntcttgaactcctgaccttggnganccanc

SEQ ID NO: 1976 - DNA, 834 bp, Homo sapiens
  misc_feature (1)...(834): n = A,T,C or G
ccctnnncgtnnntnncttatcgctaaantggtngntctnttnacccnattgnnaatnagncntttcntttcncnntncnccntctncnnnatatnnatgnctgtcgtgtcttnataantatnttataatacnnaannttgtntcgttgnctcttgaccatgacttccctgcncgttcagctntntnctntgntgaaatgggaanagacgctcncnacaagtcaataanagangctatggtgaaatgtaaaaattcacaattctactttgtttcactgagngcccaatcaacgattcatacagttgagatgaatgtgacaaaactctttatagataaatatatatgcctaagtttatctatatatatatgtctttgtgtgtatatacatacacagatatatgcaaagacataaataatcttccttacaaaacatcaatagatcattttcacagggaataagagagtacacacatagcctcctatgttggctctgagacatctaaaaagcaagacagagagcattaatcttccattcaaaaatatatccctatagaaaactttttgcagtatattgtctcttggttcaatatatagcctagtcaaaacttatttatattggctattaaaatggcaaaggttttttgtttttttttcccttccctacaaatcgagttgacattttatcagcatatcaaaagcctgtttaaggttaatatttngnctaaagcanttaaattaaaaaaagcagcccaaacccatggagacttaaagatttncaatgtntttancctcttggattnagcacatncnatagagggacttgttgggctttg

SEQ ID NO: 1977 - DNA, 1366 bp, Homo sapiens
  misc_feature (1)...(1366): n = A,T,C or G
atttactgattttcggaaaaattttcccggtttngggctttggtnacngaacntttggntctntgggcccaaanattaagcccccccaattnctttttgcggcgcnactttgcttggcnaccttntgnnaagagnncncggaaancgaatnttcacatcaagagntatattatnnntnaaanntntaatctatnngttatannntatgatataaatggggggggggtgatatttttnnaagatgnagtgntcatannatactgctctatgagtttnntaatatatatcgatannaanatatntgatgntatataaangcnatnntnnactanaaanatacnanacnntngtnanantatttgtantagcgaanttnatganttagttnacngncgnatttntncatatntcgnctnatatnaannacatanatntcatntnaacattcgttactatgatngtatatatnnttgtaagactnatntanntganannntnccnanttctntagtttgtgatanattnantntanngatctanntcgtttntntatacatagnnanacnancgtgaangacnannntannntacgantacnntaattatatnantatcngatntatcnttgacntnnnnatatacncnatcgaacanagtatnnagtatatatctcaannnttannattntangacagtgtaaccgctntnacaactntaacnctngtacatnatntntttaaatcttngntggtntntnanaactntctnatannntacgcancatactgagtntatgtgtaatntantntacttnctngtanatgataanatagtatnaccannnanaatcttncanattaatctctcnatgtngatanacgcntatactcggnntgcgcgtatnnataacnactacttataacgcnnacattatatattcgaanntcncnnananataantancannctcgtntcnctntnaantanattngnnatnnncaatacanannnggagncnnannaattatgacnaannntnnnncnagtngtaatagtcnatactncttntaatnntacncnaacnncgattattnaacntanngttanttnatacannnaaaaaannttccntaanctanaanagnnnaaaanctgnnncngaatatnnannnatnannnannaannntntgntaanaantnnatataanttnactnatannnnannaanatnganatnaaatgacnnctgannnaattgatagtcatatatctanannntgtantgaatnaantgtaatacnngnatgatnnggcnanaactnnantannannnnanagcngagananatncngnataantnccng

SEQ ID NO: 1978 - DNA, 1369 bp, Homo sapiens
  misc_feature (1)...(1369): n = A,T,C or G
ncgagganatattncggcccgnggtccgaggcccgatggtgggggnnttgggnggtccttnttggnttgggngaattggncccggnggacaccctccncatccncccaattaaccggantncccccaaatcttaccaattgggnggaaaagaccccccccaanngganttcnactnaaaaaaatatcgctantgctcagncaaatccactgnnnananagatnaagcgngnataanatcacctcatttctgnggggggggnncnctatntagtgtgaaaacacatnncttcncatcagtacccactcancantanancantgtngacaancaagacgtcgaantnatanngtnaaaanaaatcnaaanaaaantaaaaaccnaanctcaccnnnanantggtaanaatctatnatataccatnctcntnntattatatnatntannnatctannaanatcnacccntanantannctganntatnaaaatnnnaatatncaattananggnaaangcattanattnaatatcncannatananaatnataacnnngctaaaaatctatcngacannatgtctanaatctnattanncttaaaactagntcncatnntacatnntctcantntgtactatanganatnatagtnannatnacanccttnatacancaaatanantatctaantaantanaccaataataannantntncannatgcncaaatatacgnncagagnacatcttanantncttatccattnttcanatcanacananaccntatcnactatcnncannctctanaccacacatantacgtctataaacacnatnncacantntattcaanatcnctgtnnnanatttatnnacanacntnttttcatatacnctaatngaatanancanaaatntaatgtaatntatatnaacaaacagancncgtanagatcncactactttcagtgntttaaagcttnnatatannatcagataaatacgctcatcactataatatnnaaanaaaatatcacncacgtntatancaataaacttnnnnattcaaaatatcgnacgcnnntcttctctattatatnnaaancatancatntantananactatatntancaatantcatanantntnatanngatanatatagcaatacatgtnaacnagcanatcgngnaatatnncaacantncaatatataatatattncaatcnatnagtnaacnantattnaacgcaannaanatagaantaancnantaacgatncaanaanngtgtattnataaaaattnctatatataaacntagnnnccctannatgcctnctnntacactaccatcnnacg

SEQ ID NO: 1979 - DNA, 1382 bp, Homo sapiens
  misc_feature (1)...(1382): n = A,T,C or G
nttnnttcgctcccctaaatcccattccccacccttgtttaaggnaaatcnnctcatttttcatnctttttccccaggtnctttnagatgtgccacaaatcacnccacntntggntctntacttaatcgngaaaaactatcttcctgtcaaacgtntatncccggggnggggcggnnatnttttccacnacatnacatntactatgnanatcanccgctcanannnccacgtntcaanatgcnctgtaactnngctctnncgcnctancnncacncctnnncacnatcgncacatcgccactcgaanctctagncncnccctnncncntcgcnanntnncgtccncgntcnnnnancgnnnncctcncnattcgngcganantcttncccccnctttnctccgtatnacngccncgtcgcannagnanccgtnccncgntgacctnannntctccangcagntccncnncnntntggcnntgtcccnnnncganccngnntcgnnatcntanntcattncnncccntagctnnncncgccttcgtgnnnnnnncgctnncnntcnattnncnatnacnccntncnncntcnttatncntntncatgcctcacncgctncnnctcncncntcntcgtnatcacncgtncactcnngannctcaccgcnactcggngctnanaccagcgnnnncgttncnnatacgcatnctcctccntnacnatcatccncncncccttcgcgctngcacgtnccgncatcttncacngnnctcanntcatgcgtctnnananactcnccgcnnnntcccgcctctcntncntcatctctcannaatgcgcnntgcatctcncncnnctcctctgatcgccacagtctnannnntcngantntcgtncntntatncnattgcgtcgcatacnnnncanagtcgcncacactncgcacnactncnctctnctntccacgncngctncanatncncncnntnnanctgctnnnntcttatcntacnncncgcactccatcncacncgttcgtcacgtctncaatctanncctccnccncntccnacncacaccncgtctcngnntcncntcacncngcactcncacnncgncnnnatcacgcncnatcgccatntccgtanacanccncntcncangnttncgtctctncntcctncgccnggntaccnctatncnncatacnntnaactnctntnccaccanncanncccncgntctcctngcnnatcanctnctntgtgcnccgnnncncntcccncnctnntcattncanncnctacctgccgnanttcggcaaatntttcnnntncaccaaantgctcgcatcgacnncgcancccacncngcnntatccg

SEQ ID NO: 1980 - DNA, 1431 bp, Homo sapiens
  misc_feature (1)...(1431): n = A,T,C or G
nnntnccnangcacanaaactnnactcaaacantancntctactcataatantntacngnntantaanacnccctcatnanannatttanantnttcantcnatatntgcaantcatatcttataanatacncaaaagtttnaancanggggagaanagctcanaagcccccttcantnatnataatatgcnnatanctttnaccaantatatatnnctctanancaactcnntnttcnnataaggggggnnttntaaaactcncttgntcgcanncccatgacctnnttatcnnttngncnacnancctataanactctaaaactcancntnncnatannnnttntatanatncatnnnatatanntatctanctncgatatctngncntncagntnatctaaanatatctcncacancnnctaccnagtannatanntannnntacataacgnntntctatctaccttcntatngancncanatatatcctaantatgctantatcacnantannatacanacancgaaatcgntactcctctcactnactacanatatatacngctcatcatcntancctttatacnataanaacntntatancanacgnanancacacacacntaacacacanctnnttntacnnatcncnccnaatatnntgtncncttgtcactacncgtanantcatntanactcnntacngntcacgncntaananacatatcnnnnncncncactcnacanatanntattntncgaatncactctcnacacaacacacatcacngctcatatattnacantatcactncatatattacactanaacactattcacatctcnaatncncnnaaatancngacntcatntnnncnaactacnctacactntantntattnttcnagtactacacacaacnnagnncaccactnatacacatcncncngttcatgaaatatancgatanatatcanagataacatnactnanntccnntatatctgnnnantcaaatnattaatntccaaacgncnctntntaanttntnacangactnctctntattntatattantatncatccccnactctantaactacantctacgacnactannattccntnntnnctatnnattnctatcncnnnctcanaanatatnagnctatnatatcncnnctnacattactttctacttcanntatccatctaanactactatatactannttctttacttcnncnnncatncntncnacttanaacnncttcataatactgtatcattanccacagnnaantnatctcnatgattncntcnatctntatatttannagtntannnnatttannctnnncanctgcancgacctaattatnnttcanacttaattnctaganataactctgtacatcnantcg

SEQ ID NO: 1981 - DNA, 692 bp, Homo sapiens
  misc_feature (1)...(692): n = A,T,C or G
tttcaattcggacgagccnanatggtgacactgcactccagcctggctgatagagcgagactccatctataaaaagtaaaaaagaaagtcttcagtgaaaggagattcgccctatcagctatgaaagcacagaggggaggaacatggagtaggggctgcctgcagtcagatcctgccctcacaaccttgccagggaaacaggctcgtgggtacaaaggttgtgtgcctcaacttcctcatggaagcacgtgagattattttataaccatagagtggagacagtcagtatgaccaccaaacccaggagccatatattaaaatactgataaatttaactatataaaaaaatttttacaggtgtgcaccactatgcccggctaatttttgtatttttggaagaaacgtggttttactatattggccaggctggtctcgaactcccgacctcaagtgatccgcccaccttggcctcccaaagtgctggcattgcaggctgagccacggtgcccagcctgaacaccctttcctggtaaaacactccaaaaccaggaaaagaaggaatgtacagcaacaaaataaanggccagtcatgcaanggncccatggnttgaaaagtctttcaagtcattttaaggtggaaaaganttgaaaatcttttgncttccaagaatcaaggaaataangaaaaangg

SEQ ID NO: 1982 - DNA, 1397 bp, Homo sapiens
  misc_feature (1)...(1397): n = A,T,C or G
agagcttttttcggaaaatctnccgggnnggncgggaaggggactannaagggccntccggtannttaagggaaccgncncaggtttttccctttgggaatngggggnaagnccctnggttaaaaaaggnccccacnccccaaccnaaaaacaccaanntttctttaaaccccnccaatntntntacctttgtttatctngggananaccttnncangnggggnggggactttgttttntctttatagtnacgngnnantcccancatnncncaatnttttttntttannctctcatnancgtcangnatnnncanantatatctgtgncntaagnnncatatnncgcnntnangnagtatnntanaggctgnncncatagttgttnctngnntcgnttaagtcttntnatcgtctcagaccantagntntntcatattnnngtntannnntgacnntncttnaanatncagnctcnttntttgngtannctttcngnantttgtantnatctatntggngatcnncgaaataacttgtatntatagcatatcgtaaaactttattnaanctnttnnttaantannanctntnnanttaaanctgtntacnnnttaatngtnnttnnacangaannnncattanttgnnatcgcttgtnntnanccnatgtntnnncnttantttntttctacctttnctnatttcnactctntnnactnttgntgtttcatatacnancnatgtgcnanatctantgatctntncgcantattntntantagnntaangnnncttgtanttaatncatctntcactnttatnnntgnntatcnancnngttntacntntcnntgtntacnctgacnatanngtcaanacatctcnnntncgagcanatncggagtngtnctacnncnnnngnatatcnctatcatcnnncacgnncactatngatanatnctgatatatcngcnagcaatcanacatacncgtagatctcttgtatnnanncngacagagtctgtgantcnnantgcnnacncnttnnntnatnttantcacacgnntgcactnactatntgntnatttntnaatnttacatcgncnnntncatttnctcgntacnaatatactcncngtcntncaaaattctcacgagttangattgcacnctatctctannncgttnncgtctcagnntacgngatctttnangantcntannnttncagtnttnctcncgaanacttntgngtncttatatanactnccnnnancnatctngatctntctttatatanacatnttacacgtatgtgaannntctgaatatatntcattnnctcncnntaaccgacatnncatntttntatantcacagaattannnaatagcc

SEQ ID NO: 1983 - DNA, 678 bp, Homo sapiens
  misc_feature (1)...(678): n = A,T,C or G
cnncngtagacgttntnttttttntttttttggccttnttttttttttttttttttttttttttttaaaaaaaannnngnnntttttttttnnncccnnccccnccccccccnaatnnggggggggggnngnntntnaaancnntctntnccccncannaaanaaaaaannnnattttttttctccnnnntttncgnnnncnnntnncnntnnaaaanaannnnnnnnnncccccccccnnnggggnntttttnggggnntnaaaaaaantnnncccntttttnggggggnncccnnnnnngggggggggnncnnaaantttttttttnnnaaaaaaanaaantttnncccccccccngntttttttnnnnccnnttttncnnaaaaaanggggggggnaaaaaaaaannnnntnttttttttnnnnnttnaanannnnaannnnccccncccnntttttttttttttttttccccccagngnnaaaaaaaaaaagnngncccccnctnnccccctnnggggggggggaaaanccnctncnnttttttttttnnacncnttgggggngnnttttttgnncccccaaagnnngggggtgnntnnttgnnngggnaaaaanncccntgngggggcncnaanaaaaaaaangggggttttttcnttccccccccccccccc

SEQ ID NO: 1984 - DNA, 970 bp, Homo sapiens
  misc_feature (1)...(970): n = A,T,C or G
atatcgcaattncaggtctattgatttgctacatgcttaaaatgatagaggttgctcagcatttttggagtacaagggggtcagcagagacatgtgatgagggnttacnngtnatnataacccacacnntnacanngtgtccangctatttaaatgacnaanacttcnattcaacnnnantnctatgggtcnngtttggcancatngcttgnnnnatganaanatgntccnctccgcttatnatcncntnnctaattncagaaaggacttaatatctcantatccctanctnttggtacccnntcngnaantncattntncccatacnatttgtnccanttcnantcccntantnncnncagctnaaccacnnaancntantanttttctannnngcnnnaaaacttcataannanttgnantcanaccncncntttcnctaantcctnanctggggtcctnnnnaccgcctcatctancnntccgtattaccntttatncnctctatanctccgtcaacanaattctcnntctnnnnnaaactaacncctcattcannccccnactacaatncacntccacnttctactctcctntgacatctactancacctctnnntccntnatttcattctaaattnccccanaaanncgcgatacancctntnccnnanttccnnccntnncgccnctnctanaaaannnatatnttcntctannnttnnctaacatttctttnttcnatntnaaacncnnanactactnnaangnccancctcacnntatncccattacntncctttcatanncnatncccnncctatancncanacttanctttaccccnctctttaattntntntnaagntnatcttnantatantncnaggcctatcgcttacanacttncttatatnacnanccattcccnaaattnnttcnattcaataccntcnctanccntntaccg

SEQ ID NO: 1985 - DNA, 685 bp, Homo sapiens
  misc_feature (1)...(685): n = A,T,C or G
nnttgaaaatccggcacgaggggttnnganatgtncacnccnttactganaaancatacctgacngcagaataaacccacatctactaagaggcttccatggtttttactgctatcactttgattactccaataatgaaactattgaatctgtttcttagaagccaaggtaagaaagcagagaatagtctgccattgaactgatagcatctgttttataattatctggtgacttttctagagaagatgtataaaggctgtgttgtttcatgtacaccacacttgaatgattgcttcttgagttggattgtactccagttatctatttctgtgtaacagttcacctcagaacttcgtggcttaagatgcctgttatgggtaagatggagcaaacacatttcacctgtcttttctactgaactcagctaaaacacctggcctagagcaactatttgaggactccaaaagacgtatcttaaaagttgcactaagaaggagcagattttgaagtactggtgaaccagggtttaatttatcattctcacctctctcatatcctcaggcttcaaatcaacacagcctaaaacccctaagtgggacattaatggggggataaagaagaactctangaaaanccttcaagttctgggtcaaaagaatgggaaaggcgaaattgnnaatactna

SEQ ID NO: 1986 - DNA, 645 bp, Homo sapiens
  misc_feature (1)...(645): n = A,T,C or G
gatcccgaagncccaagtgatccaaaatcaaatatttgtaaaagagtaattggtttggaaggagacaaaancnnnaccactnntgacatctcatcgcctggagtnggtacagctactgggcctggcagatgtgttcacagtggaggagaaggctggccgcatccatgcagtagaccatatggagatctgccattccaacatgctgcgttggaaccagacccaccctacgattgctatccttcccacaagccgaaaaatccacagctcccaccctgatatccacgtcatcccttactctgaccattcctcttactccgagcttcgtgcctttgtcgcagcactgaagccttgccaggtggtgcccattgtaagtcggcggccctgtggaggctttcaggacagtctgagccccaggatctccgtgcccctgattncggactctgtacagcaatacatgagttctttctctanaaaaccaagccttctctggctgttanaaaggangctaaagaaggccgaaaacccaangnggtggggttggaatnccctgangaaaggctgatcaatctcaaaagaagggggactattgttgacngncccactgggaatttcagtgcacttaanggctacagatgaagagtttat

SEQ ID NO: 1987 - DNA, 1215 bp, Homo sapiens
  misc_feature (1)...(1215): n = A,T,C or G
atttcgaatcgcaannnntggnacnaaaangannttaatctttcttcaancnancgttccctgtgggacaagggatngnaacnatntatggcanatntngagagancaagcannatncaananntntgtattcnatnanntntaatatacacanaananannantananatnnntaanacataaatcnggggggggggaaacattttttttntcanantanaactcatancnctattngncgccatccatantntcgnntccaacgtctnattaantatantganntanaatctataanaatatatcnattagcatccacacatatataaanatctacatctatattaaaagaatnagacnanttcaatatacatacacntatatnatntannancatgtaatntatcanacnaaagaantaccatcggtatatncacanacanatatntaactnctntatnnanantaanactnccnnntnnaaataanntatcatnnntactatnannncnancatcatannnctntatatganntntnnaanaantannnnattnncaaatcantcantaattaatanataattgnacanacnaatntttantanatcaatataatacnnatactaanntcannntcaaganannannanctaacagaacncnctatatatanatcnanaaanatctantcgcanntnaatcaccntatatcatatctatncatacaacncttaacgtgnntcntcnnaacatncanatctnttcanaccacatcacngacaacacntcagacatatggatctcttatcanacnntnaanacanctacnatcactcgatnataccacatntatanacnantnnatgnataaacacnctanatacnnaaatcncacatacatntttanatagannnacagtnntannnataacacacattaataatttattacnaattacacagaganacntntcacatancatanaaatctnaaaaacncanntananatcatatatatcacaacacacaccnatancatnnntanatacccttactcannctatacnatatannatnanananacaactcataataantnnctcatctanncaaancttaatctcactatgtatcaanacnccctttatagantaccaacatatccacacatantcacnnttanactctctgntnganatcgtttnatanc

SEQ ID NO: 1988 - DNA, 1162 bp, Homo sapiens
  misc_feature (1)...(1162): n = A,T,C or G
nttcaancgcanngannngctgtaatccctcngtgtgatacagccaattgtaaaagactgcaaagaggctgacttatccttgtataatggaaccnnggggncgtnntnaggatgatccnccccncnccttncnncnctntcttcttnngncanaatcctnccagggaagatatctttccntgtttaaccantcttcaaattanncangngcancnnncnntatnaccnctttagcggccatctnctccntatcnnacctcnnnncntcttngaantnntcctnanctcncctctncntnacattcntgncgtanngntnttngncnnaatancnccttatntnntccacntccnanantnggntcgnnnatncnctacnccaatntntacaatctgtttcgncctattctacaancttgnttctctcaacnanatctacaacagtnccttnggtgncatcnaccnnccntcntcaacacttatacatccntcanacntctntannntactctcnnntcntctgncatnctgtatcncntctcttcnctgcntcanatccncnnnttcnnatntcctctgtactctctcncccctcctgtctantgcgtatcacntctacgtanttcgtcatacntctcccactcncacacatcgcntcnttcnccacacatacncanacngtcncccatangcncgcactctacatgcgcnctcnctctactntctnnactcgcncatctctnnctcatcgcnctccanatctccttatancncgcgannnntntngcanctttctcggnancactanctactcngagctcttcncnctctntangctantcatgngccnnnantcnctctgcgncacatctcnnatctcacaccgncnctatnctgcctgctcacgactctnacncanactnacacttccatttgtnctctcnatnatccctnccgnctcngncncacctanattcnacaancantgncncttncnatttgcactatcctattctatcnntntanctnnantccccnnccatcctnncnatctctccgnnntacancnntcttnnancctcatnggntcccgcnttcctctntcactancttantnnctcgtagacgtccctacgcnatnnntatctncnttnttttcnnc

SEQ ID NO: 1989 - DNA, 1125 bp, Homo sapiens
  misc_feature (1)...(1125): n = A,T,C or G
nnttcgaantcggcggggaggcaatactccanttngncccccgnnnngngacatcattaaataaaaagacacaanatcaaaanctattctcccantatnnnaantnncntctannaatnnggggggngtntntttaaanaantaccaantnctccaananntctccaanangtaataaaacannatatatcntctntancctntaagaaatnccacancanacgacantnttntnccnantatnntttncgttantncnnntnncagtanttcaaannattcatatnacaatnanttnaacntacttntnttnttcctnantntactannanaacaccntatnttnattanttatatntattnacnnncatnttntantgactnnnntcncaanatcananananacncaancncaagattatnntccntcctantantganttntacactnnaccncttaaacactctaancannnatatcaanatctttatcactctattntncaantacttcnaaaatacttctnnnataatatnnaaaaatcntcatctcatccaacanntatnntntantccccctatcncattgtccttctctnctccnctcngacnnctcttancatccncacctcatnncncncntatatcntacananctcannatatcntangctaatnancatatcacnnnntctncacancacttctcantatcaccatatcatcaatcnttnntngcgantnaacannatacacnnaatnnactgaactncatacngatncgccacaancactancncactncnnanacccntatcatgtntacnncncgtcanattacatnctnatacncaatactnacaccgnacactccnatcgatcncacttntncatcanactnntncnngtacaatctanacatccaacnantacnnanannnactacannccnnacacatcncgtcnnaacncacancatactagnaaaancatacnncactnnacattnannangacccatctnctnnnactncncacntnatnatnactctnctnactnatagtcantatatctaaanaaatccctanaaanaaatcgtatatnttcntatancactatnnnc

SEQ ID NO: 1990 - DNA, 670 bp, Homo sapiens
  misc_feature (1)...(670): n = A,T,C or G
ntatcgattcggcacgaggttctcccttancanangctngctttatgacaacancagagcttgagcatnttgagaaccaactttgcccaagaatattgattagtagtttctgccatggtcacaggaaaggagaatttagcattttgtgtctctgtgtgtcatacctgaataagagtctattggtgcaaaagagcatatccaatagtgatattcataaaataagtgacgcaaaatagtccatgcaggatgggcacagtatttcaataaaatacaggtagttaagtaaaggtaatttctagttgagtacataactgagacagaaaatatgtgcatagcaattttaaggtatgttaataaaaaagataaagaatttactaaaattaaattgcaagaattctgcaaccatattttctttgcaatttaattttctgtattttaatttcttgggatatatttatatttggcagtataggatggaattttcaaaaacaatattgaaaagggctgggcatggtggctcacacctgtaaatcccggcactctgggaggctaaagcagaggattgcttgacccaggagtttgagaccagcctgaacaacacagcaagactctgctcttcagaaaacaaaaaacttatctaggtgtggnggcacatgcccggaagttccat

SEQ ID NO: 1991 - DNA, 1468 bp, Homo sapiens
  misc_feature (1)...(1468): n = A,T,C or G
nnnnngcnntannntnntnaantactatcnnacnnntcnannacgctgcngaactatnnnaanaganntntncnnncacgacnnantantactaactannncggngnagtnatagctannagcgancttcncntcantgatgntngacncacnctncnntactntcanncatacntaatgatcngtnacgctaaacattaaatctnnnnnccacntntannnancgaaanccgggggggaaggtnattatactaaagnagggcccccnnnncagnaaacacctctacacatngnggnatntgcattcgtatntatatacgaacngnaantacacgatatcnatgaaananatggggggggctntagagnananngangttntcnngncntttacntagannccngtcgnanantagnatgaantcnnnnaagtnaganttgnnggnancnntagnntnnanngnaatntcattnnntnnnnnganagnataatgncgcnantgtngcgaatnctnncggncntcaaaccnanagnncngcganctncnnnngaccgcnnnaannaaganctacaancgtncgnngcatcncnnnntnagatttcnaaancgtgnancanaanntnaactnaantatntnnccggnnccgcaaatatgtannanacntggngtgggacaantgcgnagagacgtgtagcncantgctcnnnggancnnnnnagatnatcgnntaananagangancatacggagganaacnanantcatcgcacgccgcgtgtacnaacancgcactntnggntgcaatacancnnananngtngtgcnctnatanacgcnganatagtgctcaanatcngntgtatctatnatntantatatgtncgaanangaganancaggtacnnanncacngtatacgtcntagcacaangaaccaancncgccnncagtatcnnaaccncnnnacanacgncgnancaatcanncntacngcatncnacgnntncgngncatatatancngntcacgcanaagnaacgacnagncngtngatgcgacgtngcncgcagcanccnagaannncnnnnatgctntcnnccnnacngcngaaacngntnannnanacannnnnnnccgaatgtcctcnncnngannccgnttannancganctatncnngatncgcacnnnnnntcntnaatctanccnntcgntncatactnntccganttggacnccgctaacngtaatatanngnactncgnncacgtncgncacgagnntnnanagcgcgncgcanannnctgcnnnancaagncanatcngcacantcnggntntcntgtcgatanccnacanncgtntcgntantcancntatgntnntgnncacnagnantnncntcnaatncgtancanncaactancanncncccncnncngnnacaaccancncanntnncntccg

SEQ ID NO: 1992 - DNA, 1461 bp, Homo sapiens
  misc_feature (1)...(1461): n = A,T,C or G
gaanaacntangtnngattaatnggtganaanngcaaatangcattggtatganngnnanttngagaatgtatntntcgtngtnataacncacnngacganaactgtaaatannnntnttttntaagagaactganacanancatgganncggaacnatcaagtannngaaataaantgcgtnangntatatcantagcatanncntaaatnnnnnnntttaannttnntanaacttcgggggtgtnanttanccccanaaacccccngcggnggggggnangnannnaaaganatnnanttannacncntaaatactaannntcttgnnnantccanggggttntttnttacaagatgtgtggccaanaannnncaganttttgtntttatagnnttttnngnattnnntngtngatacntgtnngantggaanctannattgnangtgnntngaanntnnanantnganngnanagnanncngnntnagtatggcnaatgnattaagannggntnatntnggaannacnatntantcggagngnntgtantngggantnatttaggacggtnttcttatnantnngnanngnncantnnanngatatattcnattatngcgaatgggtattanaaattgtnntgatntntnntnnntnnntgatnnnnatgncnataantgcattggtcnanttnnacanangncanaacnatanttaanttgnnnnatagtatacananaancntgcnnatatgnanacaatannttnncggaactatacagtntnngccananttcatatgttggaacacttncgncacnngtctagntctatagananatatcnngggtgtgtatgagantnanagatcgcnngatctncagttatatgtnnattaccatnatanatagatnacgtacgngcanaatgtgatanntcatacaangagatcnangaatnttgatnntgnagntgtntgattacntnncnatactgatgnnagnagtancgctncnnataaacntgnnattangctngtgatangngttatgttgagataacatantannattaaactnacgagnatanttaaatattancntttgtnatantgnnnnnaaagngatcnnatananangtcngagtatactatacatgacggnagcncanttntganagngatncagatgtatcngtgtncgncanancancatccaatataaaaangttgatcngtcannnagcncagtgcncgnataaatnntacacncgtangnaacagatngattaactacaanatacacatcaganctgcgtgcanatgcagaangtgcnngtcatcncgnnagtgtatgtgnatgaatatcngaanganactactcantgaagacgagatgcanntnnnaancnnacatagacactcggaacgcatagancnctnctgggantgaactnnnn

SEQ ID NO: 1993 - DNA, 679 bp, Homo sapiens
  misc_feature (1)...(679): n = A,T,C or G
tnatcnttagcatacaccctcagggagtcacagccttccaacgtccattcatggagcccaggtccaaaacctgtgatccgagaataggataacccttttctgcccatagggtgttttccaaagacctttcattgctctgggttacgtgggaaacaacaaaacagaaccatcccccgcactggtcagctgctacgggtcacgccagggaaaagtgtggactgatgtatttcgttgtttaccatgtttctagccagagctaatttgaaaataggtatcccaagaaccagactgcaggagtatcccaaaataaaacattttattataataataatgacaaggatggtatttttcttccatctcaaaattgtgtataatgcgatattcaatttatagtttaataaataaaaattcttatctcttacgaaaagtttcttttagagctgagctttgcttaaacatttattatccatctgctttctcctaatttgaaaacaagcgataaagcaagcaatttacattcctaacagtgcctaatgagacagtttattcattcagtcagtaaatatttattgaacatctactgtgtgccaggcatagggaaggcattaaaaagatcttgctgattacagtcaaaacatagtccctactctcatggggattttacaacctaaactcatgg

SEQ ID NO: 1994 - DNA, 701 bp, Homo sapiens
  misc_feature (1)...(701): n = A,T,C or G
tnnntcgtccctaacgagggtacctggtgcctctgactgcgcctctgcctttgccgcctggctcctggtggttcaagttccagaaaggtccgagggctgtaaggtccttagagaacctagaggctcctcctaggaacctttaaaaatgataccctgccctgcgttggagcctgtgaatttctttgcatgtgaggggccagctgtcaggtggtcggctgagccagggcagacccaggagcccagcacgccatcgcggaggcctttctgatggcacaagtgctagccgttcctcctgcttctccgcccacttggccatgtctgggaaaaggctccccccagctcccttgctctccctggagcaccacgggcaggactctgaccggggatgggcaggttggggcattctggagaggaggttttggagtgatgggtgcagaaggcgttcagggtgggtgaatttccctgaaagcctcaggccccagctctggctctggtccttcaactcttaaggcccccttttnttcatcttgaagaaaatttgaactcaaactcaagggttccccacctgggggggacgccacanttggccagtntgccgtgggaggtccttaantggtggtctgaaggggctnctancgtcagaaaagctctgcagaagcccctgncccaaaggtgtctggtttggggctaaggtgatgccg

SEQ ID NO: 1995 - DNA, 1227 bp, Homo sapiens
  misc_feature (1)...(1227): n = A,T,C or G
ananannananannnnnncnangnnanncnanncnaanaaannannnnngncnaangnnnanannnnnnnannannnnnannngnnnanagnnngannnnnnnnancnnnnannnacnnnnnannggngngangnaggacgannannnnnanngaangnangngagggccgangangannnnnanacnnnncnnnnnnnnnnagcctnnggaaaacccttnngnccaaaacnaccccgnnncnntttnngnaangggaaaacccaatcggnaanccccccnggggancngggantgggnaaaaacggaccaaacaaagggaaaacctnggaaaagggcccggaccggggggggcncggaaaancaccctngggngaaatcctggggggggngncggggnaanaaacnggaggcccgggnaaaaaaaaaaactgggactccaaaacnaccacccgggaacccaanccggnaccgggccananntcggnaaaaggtaaacctnccttnccccaaggncntccngggnnactcnggcntnggaatgnctnnngggggaacccaangggggngggaagggaagncacccancnaagagggggaagggcncnaagggggggaantgggaannngannnnccaggggaatggaaaanaaattngggaggggggaaaaaaaaaaaaatgggggggtnaaagaaangccccaaaaggaaanttgggggnaaangtaaangggggggggaagaaaacaaagaaaaangggagcccngggggnctnatnggggggaaaaagggaanntnnggaaaanaaaaggggaagnccnggggggaaaanaatggggcaggggaaaaanncnggggnaaaccnnaaaaaaaaaaaangggggnccntttaaaaagaaaaccccaaccntcccnnaaaanctccgtnnccccnaatcccaaaacccaanagncctgggccgggacccaaangnggcatcntnntnaccctggcctnancaagcattatnggcccccaangccnccctccaaaaaacanctggtnccccnggggcntaaagggcaagggggaaagnaaggggaanaacaanggattngggggggaaaaaggccntnaaggaaaantgnganaangtgggggaagaaggaacaanctnggggggcttngggccaatgnnnaaaaaagaaagggacngntnacggaaaccatatcgggagaaaaaaan

SEQ ID NO: 1996 - DNA, 764 bp, Homo sapiens
  misc_feature (1)...(764): n = A,T,C or G
tcaaattcagctcnttgcctntcngnaggatcccatcgattcgtctgggagctgattggagaagcggccaagagtgtgaagctggagaggcctgtccgggggcactgagaactccctctggaattcttggggggtgttggggagagactgtgggcctggagataaaacttgtctcctctaccaccaccctgtaccctagcctgcacctgtcctcatctctgcaaagttcagcttccttccccaggtctctgtgcactctgtcttggatgctctggggagctcatgggtggaggagtctccaccagagggaggctcatgggactggttgggccagggatgaatatttgagggataaaaattgtgtantgagccaaagaattggtacnantggggagaacngataggagctgtgntattgnnaatgatncgnttantggagntncaattntngctnaangtnnngaactagcttncgntgnncctnaccnnanaatgcntnccnagcccctggaacaacatctgaagagccatgtccccnaggtccaccttctgcttctgangggggctcccgggatgaacaggatggagcttcagctgagacagaaccttgggcagctgcagtccccccngaatgggtncctattatncagcaggacattcacagcncagccggaaaggtgaaaccgcagcccnctctgagtgatgcctaacttanttgggatgcctgcccagaaaccccagacgatgcatggtganggccccct

SEQ ID NO: 1997 - DNA, 731 bp, Homo sapiens
  misc_feature (1)...(731): n = A,T,C or G
gnttnaatatcagctntttgttctttctgcaggatcccatcgattcgaattccgttgctgtcgttcccattcagctcttggggtgaagccttattcctgatgctccagacgatcaccatctgcttcctggtcatgcactacagaggacagactgtgaaaggtgtcgctttcctcgcttgctacggcctggtcctgctggtgcttctctcacctctgacgcccttgactgtagtcaccctgctccaggcctccaatgtgcctgctgtggtggtggggaggcttctccaggcagccaccaactaccacaacgggcacacaggccagctctcagccatcacagtcttcctgctgtttgggggctccctggcccgaatcttcacttccattcaggaaaccggagatcccctgatggctgggacctttgtggtctcctctctctgcaacggcctcatcgccgcccagctgctcttctactggaatgcaaagcctccccacaagcagaaaaaggcgcagtagagccagctactggagtcattccgtttccactcattcacccaacctcagggttctccccatctgagccagcctgctggtgtgacttactcatccttcattcctctgnacttgcagactttctgagccaggggttttcttttagtggaaacaaatgggtgatggatccagatccttngaaaaggagaggattggggtanagtctnccaagccaaaat

SEQ ID NO: 1998 - DNA, 729 bp, Homo sapiens
  misc_feature (1)...(729): n = A,T,C or G
ttaataaactgctcttgttctttttgcaggatccctcgattcgcttggttgggataaacttgtgtatgcggatacctgcttcagtaccatcaagttaaaagcagaagatgcttctggtagagagcatttaatcactctcaagttgaaggcaaagtatcctgcagaatcaccagattattttgtggattttcctgttccattttgtgcctcctggacacctcagagctccttaataagcatttatagtcagtttttggcagcaatagaatcactaaaggcattctgggatgttatggatgaaatcgatgagaagacctgggtacttgagccagaaaaacctccacggagtgcaacagcacgcagaattgcattaggtaataatgtttccataaatatagaggtagaccccaggcatcctactatgcttcctgagtgcttctttcttggagctgaccatgtggtaaaacccctgggaattaagctgagcaggaacatacatttgtgggatccagaaaatagtgtgttacaaaatttgaaagatgttttagaaattgattttccagctcgtgctatcctggaaaaatctgattttactatggattgtggaatttgttatgcttatcaacttgacggtaccattcctgatcaagtgtgtgataattccccagtgtggacaacctttncatcaaatatgcttatatgantggctganaggactactaactagta

SEQ ID NO: 1999 - DNA, 689 bp, Homo sapiens
  misc_feature (1)...(689): n = A,T,C or G
gttcaattcgangagaggaggcttgggtagtgcagatttgtgtatttcaatctttgaaagctctgatgtaatttagaaatgaaatccaatcatgagtccaggtagagaacgcctgctgtaatctacactgttgctgggactgcgcattctgtatataactgtgttggatgagtgacagatgattgtccagactaggacagcggcatgaacatgactttggttgggattgcggatagttagggttacctctgaatcgtgtagcttttatgagagcagctgtgcaagtgaatccacattaatgccttgtcgtggtgccattcccagcgcctgacgatacgctcttctattgtcttattctggcaggttttgacgttttaaattttttaaagaaattttattccttggaccaaaaggtttggttaaccacccccctcttacttgctttcacattttgagtgtccagaggaaacagaaaggaatgagtgtgtgacgtttgctgcacgcctgactctgtgcgagcttcttttctgngnatatattttggtttatttttttccgggtatatttttaatcccgacagaacatcatgtggagatttcttttaaaatgggaattaaaaccgatttctttcanccctgaaaaaaaaaanggtttttgaaaaatngttttccttgnaanttttgntttgg

SEQ ID NO: 2000 - DNA, 796 bp, Homo sapiens
  misc_feature (1)...(796): n = A,T,C or G
cctcgattcggcgcgagacnnanngagagaganngcnngagagngagagagngagagagagagagagagagagagagagagagagaganaganaganagagagagagagagaganantgtntntntnnnngngnnagagngnnacannccntcncncctcctagaganctgncncnctgnccttggcttaaccnntaaatatanctntnttctngtncctgggtgantttntcnacaagaccttgtttccccnnntctttnctcngaaaccngtcntnctgcccctctnttntccctcnctctctctntgtgtctcacgctctaaacnctttctcgcgcttgttnttcggtgaaanatttantnntccatcttcgtgttggtgagcggagcccncntttntgcctgngtctctctttttttnatagnntncccttcttcttcgaacncttctncccccccccttnaatggccggcttttttnttantncnntggtgattncccccccaacgggaagggggggggnaaatnttgtccttgtggtcctgttttcttgccnnggggctttnnancttctnggtcctcctcccccccctggggttccannccangggtccccnctttcccnctntccngggcccccccccccnngagaaggggcttctgggncncccccttggcnnnccccccattaccccccccgggnccttggnttcttnnaanttgccgttctttggggtcattgaaagccccccnncccctnntgccngtattaaggccttgngtttgcccccccn

SEQ ID NO: 2001 - DNA, 1126 bp, Homo sapiens
  misc_feature (1)...(1126): n = A,T,C or G
cccnancnnncaannnncannnnganntngnngcanngnnnannnggcannnnnangnntcancncntngnncannnnanncnngacannngcnaaannnnannnnatnccgccancnggganntnnaaangacncncannngngnnnnnacgnangngnnngcacgnacgcngcgctatacganncacanacncnanannaanacncntgcgnnnngnnccnntacgatcctnnaanacgcnacnanntnacnnncncnnncnnaacnanggaacncggnggngaaggaanagnccacaagggaccncnntgcggngcagtataaataagannnnnnccagnacatgttttnntacctctgctgtgggatnttnggggncattactttgttgatctactttgtagttaacctagagaagttaacacagccattgctacagagctttcngccncttgagtgccagaantccataatccagttatccnanggattgtgggggagnnaaaagaggnantncgggcatggnnncnttgaatggggagcaaatacaagtccnttannngganaagtggccnataaanngtcttangtatnacaccnnggcctgtcantattataacatntanaanaaaacccgaccaataananantganccatntggaaaaacttccctttantttgcgaaaacanggangaaaancggttgacggaagaataanaanaagnggggtccaaaanaaggggtttcaacttgnnnggaataatgnangtcgaagtttgccccancnagggatnggaattaggggtgaaancgggnaatgcctgnaaagnnggggccaaaacccccnnggnnaatanaancctctcaagaaagccatcnncaanggaannangggccntgggnngananaanccantaggnanaatnatgnngtggnagactaangggggacncnntncgannagggagnggtnaagggntcaanccgncntcgaaaanaanaggcccctanggggnagnccnnctaatngggnccnaaacnggagtcataaaagccgngcncaaannncnagaacnagcagcgcangnngaatantgncnnnaggannantntaaaccccg

SEQ ID NO: 2002 - DNA, 679 bp, Homo sapiens
  misc_feature (1)...(679): n = A,T,C or G
gttcgattcggcacgagattatacccaaanaatgggatgcgtgtgggacagcttttaaagtgtttgaaagattttgcattcaacattcaggctatcagtgactccttgagtgaactatgtgaaaataagcgtgacaatgtagtcctggcatttaaacaattgagtcaaaccttttatgagaaacttcaagaaatgcaaattcaaatgagtcaaaatcatttagaataacaccatggaaaactttcaagtctgattatgtggtatttatccctttgcaaggagagatataattaagcttacacaatgaaatggaaaaaatgtttgtcttggagtcaaacagaattaaactcagataccagctctgctattttctaactgaatgactttaagttatgtaatatatctgagctttaacttcatttttggcaaaaccagagtaaaaatgaatacctctagttgttttgaggattaaatgagataatgtaagaaaagtgattgggattgggtggtgacttaatgaacggtagtgggtttttaagtagttaatgtatagcaaaattaagtttcacattgtcaagttttcaatacatccccaagttaattggaattttaaattaatggatcaaataaatcacaaaggaccccaaatcaattctgaacaaacaatttagtttttgta

SEQ ID NO: 2003 - DNA, 684 bp, Homo sapiens
  misc_feature (1)...(684): n = A,T,C or G
antntcgaattcacaccagcncnctnnaaacctttagnctgctttaagaaaactcagtatctgaaaatcttaacttagcatgtgatactgtcttatcagcatctgcagaagtgccaaagccactgctagacacttaatgtgtattatttcatttaattatattttaaatgtgcttccttggtaattcttaagctcgagaaagagtttgagaactgctgctaggaaatagagattcacatttaaccctgtggtacttttaagaagcaggtacgttgttgcatatatacttgggtagagattggtaactatctgatagggaagctcaagttggccacccaagtctgagaaacccttaattactgagaatcaaaagagcagaatgtctgtagacattttggatttgtaaaaatcacattgttgagttatacctgtgatgggctgaaagtttttggcattctttcctgttcttcatatgccagtaccataaaccaaaaagtatctcagatctgtcactttcttctcctaaaccaatgtgattgcagcttttttgccttcagcccttttccctatccagtatctcctacatagttaccttttgatcttaaggaactggtttgaattggggtcacttccttgcctaaaattccattgaatggtcattggtaaattctaaaaataagagtt

SEQ ID NO: 2004 - DNA, 1508 bp, Homo sapiens
  misc_feature (1)...(1508): n = A,T,C or G
tgnaccnnncancnnnccgcncccnnnngacnnnnncacancangncncnnntnncncaannnagcnnnacncncntctgnncttcncgngcancnaacgnctcccngcgnnggctcnnntcactnctacnctcntcaccncncannnnagnngnnttgacnngcgcnngacnntancacctcacnanacggctccntccannncgnnctncncnatctccgcgcnggcgnnnnnnnnnnatngggncgnaggncanctattncgtccngacngcccggggnaganacgcnacaaaccttnancngggngtgtcncaggngggnatannaggnttccncncctncatgnggccccngggggggganttcncnactcgnnangtcgcccccacncacnccntgtaccgcanngncccacncaacagnnntgntcnagccccactgccggncncaaatactngacgcacncngnncnncngncccnntnnnctccnnaacannacccnccaccnccncgaacannnnnncnccggcncnagcnnncgnatncagatccncanngcnccnccctnctncnancngtccgactancaagncgnnctnaagnagantncccntntnncncntnnccngcacgncnatgacgncncacgccnnttcgggnagccgcaatccgcacctncnnctactanccatnngcnnntccncaccngtctanncgntgtacncgcgcantntcntatccnncnnttnctnnngaactgtgacccctnacatctcntacgcgcnctcngcncannctncnncanatcgtgnanactnacncnctactcancacntcgncnacgcnnaacgnaccgcgnnccgnnttntccnatgacgacaangcgcntancctcgatctgttgnnntataanncngcgggtatncacncagaanccacacgcgcgccaaacannncgcatagcacactnnntacncgctnnaacgnangncnaccgannactcantcanccgacactnanngngcncngcgcgcgctnctactctacctccgacannnntcngcnacancatcattacgcncacanaccncccatcacncaccccaaanacantncgtgcngncgncngcgcanngcacatnncgananaacnactccgtncgacngacgaatacacgctgtcagactcgctctanccgcgctgancttncgcacnctgcacgcactnnntcncananncgcgtcantngactctatacactgctcacgactcngcgcancgcgctangacgtntcnngccagacacaacaccgcacncannccngcnctgacgganccnctctcanacactccnccaacntccctcnccnnngcnatcngngacagcgacgcataccnncatnnacgctccgactcnnncgacncacnacncnngcatcnnncatncgaacgcaagancnncgcanncgcgcgtncagnncncgcctnacnncacgcncgcg

SEQ ID NO: 2005 - DNA, 878 bp, Homo sapiens
  misc_feature (1)...(878): n = A,T,C or G
tagttatncggaanttgctggggggggggaatnaaatatttaccaccactcaacaaggaacccnccnnccagttagtcatttantaannagtaagctagatagatagantnctanaagtttangnaagntnaggaagctntcagatantttangnactcttnattntantanancagnnnngnatttaanttgngggggggggggtgtattattttttatnnaancgnttnactngntaagnaaatcnaacattctgtngnagtatcttatgtatgtactctncaacatnttaatantatantggtcatntntatgatgnttttaaataattgtncntnnatannnntgttnatancntnttgnnnttttacnacatntttttnattttantannanannttnaatannttatntagaaattnatactatattnncnttnnttatttatnanttnttnatttntagnttttacnaagtagttgntntttnnnttanaanntnttntnnntctaaaatnntaatantgntatcatattttattttttannntttttnttatntatttattnntatatatttgannttattnttcntcttnttttttattaattttnnnnnatttttcgtttgnttataaatcatanttttnttnattnnnatctaatnatannnntttctnnanattggangttnnttntganctnaanattgnttctanntnnaaattntattttnnattattttntangnttttnaatttanantatnctgnnttnanccntntannataancanatttntaatnatttcantatcaaatnannnactatcnntnnatccnatnntattatcgtttatataananctttcttatcnn

SEQ ID NO: 2006 - DNA, 711 bp, Homo sapiens
  misc_feature (1)...(711): n = A,T,C or G
nttcgattgacaagacaggttgctgaggggtcggcaagcatctgacttgcccaatcccctggatatggtgagccccgccatgcttttattctgtatcgnttttgtctttattgctgctttcaacatttacgtttggttacagttaactattttcggagtgtggtgattgaagacaatttcatcatcccactgtactttttttttgagagggagtttcactcttgttgcccaggctggagtgcaatggcacgatcttggctcactgcaacctctgcctcctgggttcaagcaattctcctgcctcagcctccanagtagctggaactacaggtgcccgccactatgcccagctaatttttgtattttttagtanagacggggtttcaccgtgttggccgggctggtctcaaactcctgacctcaggtgatccacccacctcagcctcccaaagtgctgggattacaagcgtgagccactgngcctggccttttttttttttttttaaaaaaaaanggcnnnttnttttngncccccagggctgggncttnganccccnggagatnnaaangcangccccncctggttttnaaaaaaaacaggtnaaccgggggcccccccccatttaancntttttataaaaaangganttcctgggcncaaaaggggaattttttnggngggggtttccgcgnaantggggntccaaaaac

SEQ ID NO: 2007 - DNA, 708 bp, Homo sapiens
  misc_feature (1)...(708): n = A,T,C or G
gtttcncagatgaaacagaacaagtccatttttattttctttcactgcattgcatatggtactcaagttgtgttgtgtatagctaataggatgccattcacattttatacatcttttttttttttttggaaagggagtnncnntttgcccccnnggnngnagggnaggggccnaatntgggttnanngaantnnccncnnccnggntnaanncnnttttttngccnaacccncccnagaannnggaannanngncccccncnannncccngggnnaanttttngnnttttaanaaaaaanggggttcnncnanggnctaaannnccnnacctnggnanccccccccntaaanntttngncnangganggnaaatnattngggnccngnnttttaaancnaaatngggnanaangaaaaaacccctngtttatnaaaaaannaaaanttncccngncnagtgggggggnncctgaaaccccagntcctnggnaagncnggggcanngnanccncttaaacctggggggcnnngntttnaaaccccaaaaatnntccccctttaatnccanccngggggnngaaaaaaagaaaaaanttnttttctaaaaaaaaaaaaaaaaaaggggnntccctcccggaaggaaanttnaaaaaaaaanaaantttttttttttgtccncaantttnnnncncncccnnntaanancc

SEQ ID NO: 2008 - DNA, 686 bp, Homo sapiens
  misc_feature (1)...(686): n = A,T,C or G
nntcattcggacgagtctgggccctaggcctcccaggagcaagtggggcctctgatggtaaaagtcgaggagaaagaagagaaaggcaagtaccttcctagcctggagatgttccgccagcgcttcaggcagtttgggtaccatgatacccctggaccccgagaggccctgagccaactccgggtgctctgctgtgagtggctgaggcccgagatccacaccaaggagcagatcctggagctactggtgctggagcagttcctgaccatcctgccccaggagctccaggcctgggtgcaggagcattgcccggagagcgctgaagaggctgtcactctcctcgaagatctggagcgggaactggatgagccaggacaccaggtctcaactcctccaaacgaacagaaaccggtgtgggagaagatatcctcctcaggaactgcaaaggaatccccgagcagcatgcagccacagcccttggagaccagtcacaaataccagtcttgggggcccctgtacatccaagagtctggtgaggagcangagttcgctcaagatccaagaaaggtcccgagattgcaagaatgagtacccagccccganggaatcagccagatganccagaaagggttttgaancanaaggggcttaaaaggggatatnaattttctggggattattcgcca

SEQ ID NO: 2009 - DNA, 1187 bp, Homo sapiens
  misc_feature (1)...(1187): n = A,T,C or G
ntcactntttcgtntctgacacnacnntntcnacnnngncaacnctgacntnactaannaaacgcantctncgntcatactnctcctntcgntatacaagtcgcatttccnctaactcncactcnncncatcgcgncangnngnagtaaccnnnnaccaaannnnaannatgatctcgnncccngtattnagggngnaaccgtgngtcaatataanaccnannagcncccnnaatcngnnnatcctannncnaancanctnnatatangtactnatcattanatcccttaaacntaannnnacntnnnaaannaacggggnnnnantnttaaaanttanganatcgancncataanacnnncanntactcctgnnnaangncanatanaanaatangcaatnanntcaannagtanacancnnntnacnngccctgataanaatntantcnannnctnttaccantcaactgncanaaannatgcnacnaantnacccanaaataagntnaacntactcntnactnctnnnantctanctatttnnngnnntaaancnctgactatnccnatactnncncttnnanantannnatataannnctgtnntttacnctttncccancaannttcnntcncncantncannactgaatcancaanatncannnccntntntatcannactttgaactnagnanatcnanncaatatnatnntanatnnctgacaantaannnagcattgaaaaaagncntcaatantnttnanncanacantannataaagcctgngnattacanntatcactnntacanaatnttanatccaaatanaaattnaanaannnnccactaanntgcaatncaatnnaaattnttanntctaannntnaatnatcnnaaatnaaactnannaatnanaangnantcgnannaantnncnaccataactaaanctnncatantnnntatnccttccncncnnaaacntnccnacctgaatccatanaataatcnannnnnngncacttnnttnannnananagcntnntcanantcnngtaatnnttcanctnntttnnagcaatctatnannanannangnatnggnnaaaaaactnncancagananncttcccnatcnttatcgnnantcaaancaagacnnngttantattanacaccc

SEQ ID NO: 2010 - DNA, 1055 bp, Homo sapiens
  misc_feature (1)...(1055): n = A,T,C or G
tctnnnnntntanaattntcnacnttncnttatnaanntnatatcnccntcntaagtactntntnagggcnaannaanntttaaanntcgcccttnttcnnntttaatatnttttnnatttccttatnaaaatatnatacantcggggnntnactcatatancnagntggnanagccaccntttgaaagctctgatgtaattnnaaaaagaaatcaaattannggggggggnttttanagaaatncctccnaagcttnacangnttgtttatgngcattatnnntntaactngtgntttatnattcanttnatanaggccntantnttcnagatnaaactcaatnnttntttnnnatnnctnnanntnnatatattanncanttantanatanattctnncttnaanaanncgtnnantgannncnnntataaatcttnntttntnnnncncttatanacttnantcatgnncnatnnttaatnttntaacaaaangtncattcngnttnnnntannanaaaatnancnttanancancgnncnanntttgtaaccaanatngggntttgggnttaaacancaccnnatttttttaaattntnctnttnaccaatgnttnngntggtctcnantnatgganaaanncnaaaatcggtnnacattnctgnntntncantnatnnntncctatangcaaanncnctaangnatnttttgtgatctnataaaaccnnncaattcattcngggaggctaaantcacaanntnntatgnagcantnntatanttntatttttatnaccccangtgtaccataaaatangcatatnagaaaannacacccnccancttnggatanacaaantcnacatagtcgcaagagaaaaaatacatcctntttcncaaaaaangatcggtnannantnaaaaaacncacaanatttnntcntatctnacagctccactcnnananagaaaanataagagggacgtnattatnnctagnaatagtntattattncactcnttgtgnnacctccacncngtgtnnttnc

SEQ ID NO: 2011 - DNA, 673 bp, Homo sapiens
  misc_feature (1)...(673): n = A,T,C or G
gttcgattcgcacgaggtgcgtctagaggaaatgtactgttttgcagataataagtattgatcagacatgcatttttacctctgctgtgggattttagtctcattactttgttgatctactttgtagttaacctagagaagttaacacagccattgctacagagctttctgccacttgagttccagaattccagaatccagtttcctagggattgtggggagtaaaaagaggtatagggtatggtccctgtatgggagcaatacagtctttattgagtagtgtctatattgtcttgtttactcaggtatttcatatatacattaaaaaaaccgacaataaaaatgaacatatgaaaacttccttatttgtgatacatgagtaaatgttgatgagattagagaaggggtccaaaaaggtttctctgaggatatgagttgagttgcccatcaggatggattgggtagtggatgctgatgtgggcaaacactggaatagacctcagatgctgcatgatgtgcctgtgtaacacagttgaaatttggtgatcaangggacatattacagcagggtagggcaacccgnctaaaaaatgacttggggtcctttaattgggttatgttgnacatggnggaaagaaganaaggccccgaaatgaccatggcatanaaaata

SEQ ID NO: 2012 - DNA, 678 bp, Homo sapiens
  misc_feature (1)...(678): n = A,T,C or G
ntncgaattcgcgngagggaatctccaccctgtgctgttttttancaatatataataaaagccaacatttattcagcactgaagtattttatacacattngctcacttaatttttacaacaaacctgtgtgggaagtactgttataattaatcgtcattttcagataagaaaatagcagctgaaaaagtaaaaataatttcctcaaagacagccagggcttaaatcaggcctttctgatgtagaccatgctcttcactaccacagagttccatgctactttctctccctctccctcctctcctgtccctgctacacacacacacacacacacacacacatgcacactcactcacacacactaggaggaacaaatgagatcattcacatgaaagcacttatgtttctgaaatttaagggactgtggtttttatctaggntgacctctcaagctaaaaactgggaaccagaataatggactgaaacttgggtttcacttccagaccagtgttgatcctctgaattgatgaaactgtatagatttccctcttggatgcccctgctaacatggatttcctttcactcaattcctaatgcaaatatttgctgaccactgnttaanaatgttacatgcctgcattacattggatattttactatttggggggttngtntaactt

SEQ ID NO: 2013 - DNA, 658 bp, Homo sapiens
  misc_feature (1)...(658): n = A,T,C or G
naggngttgagaaccgagctantaaatcaaccagtcaganaggccctggcaaatgtagcctacatcatcatagagtccaccgaggagggcacgactgaatatggcttgtggaaggactctctatttctggtcgacctgttgtgttgtggtgccatcctcttcccagtggtgtggtcaatcagacatttacaagaagcatcagcaacagatggaaaagctgctattaacttagcaaagctgaaacttttcagacattattacgtcttgattgtgtgttacatatacttcactaggatcattgcatttctcctcaaactcgctgttccattccagtggaagtggctctaccagctcctggatgaaacggccacactggtcttctttgttctaacggggtataaattccgtccggcttcagataacccctacctacaactttctcaggaagaagaagacttggaaatggagtccgttgtgacaacatctggggtgatggaaagtatgaagaaagtcaagaaggtgaccaacggctccgtggagccccanggcgagtgggaagcccgtgtgacanaacccacccttgaggatggcctgtccaaggaaactggtaacttattcatagtcctattgggacagcaggagcagcttctacaggnga

SEQ ID NO: 2014 - DNA, 669 bp, Homo sapiens
  misc_feature (1)...(669): n = A,T,C or G
ttnnnnnantngccgaggtgacattgtgatngcanganangntaacaanttattaatacaaatagtactgtatatgagagtacacattaggaatgctgtgctttaatgcataaacatgtttacagtggtccacatgtgccaggagatgtgggaatggctacccctgaagtcatatggagaaatggggtcctcatcgcacaccatacacaaacatcatctcacaaatggattaaagacacttaagacctgaaaccaaaaaaactcctaggagaaaacacaggggaaagctccatgacatcagtttcggcgatgatttttttttggacatgacactaaaagaacaagcaacaaaactaaaagtaaacaggtgggattacattgaagtaaaaagtttctgcacaacaaaggaaacaaccaacaaaatgaaaaacgaacctgtgaatgggagaaaatacttgcaaactgtatatccagtaaggggttaatatccaaatacataaggaactcatacaactcagtggcaaaaaccaaatacccattgaaaaatggcnaagagccatagtagacattttttcagagaagctnttcagatgggccacaggtatatgcagangnctnagcatcnccatcccagagaaatgcngtccccacagtgagctgtcactggtt

SEQ ID NO: 2015 - DNA, 689 bp, Homo sapiens
  misc_feature (1)...(689): n = A,T,C or G
cnncacnatgagntgtgngtntntgcgntgcnattcacctcntatncccntacgtgtngtnntanccagnactctnnaantgacctggtgatnaagngacggctgnccnctgtgcnaatgttgngggncaanggagcnatttatnatcanttttntaaacctggtgnaatcantntgcgnattgtggataccacccaantcccatgtnttnanggaaaggnanntctctntcccantccaaaatggcctnnggttgganggncatgnancctacgcctntaananccagaaattngtnggccctgcatgcantgtgncaanangaccngtgctngnaccnttnagcccacntgntannccnantctactaacgcttggagnncacccggnccatggtnggcagtgnctgggnaananattctactnagggangctgccgngctnaaaanggggcttttacccccnagacgggaaattgtngggaannggaggagnnnnannaattgnngcttcctggcttggggcaaccanganntggaaaacttttnnttcnaatcccnctccttttagnnaaaaaaaattngnnataaaacccncccanaaataaaaaanntttccnaattttttngttcccngggcaaaannantnnnttttattttntgnatcaaaagnaaanttttnctgncct

SEQ ID NO: 2016 - DNA, 670 bp, Homo sapiens
  misc_feature (1)...(670): n = A,T,C or G
ttntcgattcgcacgagggnacccacagctctcatcagaagcagacacagatactttttgtaggaaaacatctctaacttaagcctgtaggattcccaaagattaaaagcaggcaaatatgaattcagtcaaatcatagcattcaagtagtctcaacccaacatatttgagaattgttagaaacaatgaatatgtttcccaaagactaggttttggaattatcagatacagaacacagacttcaaatattagaattgtgagaaaatagttacatgtcaaacctaatataaaagaaagatggactcattaaattgagcaacagaaaggccaccaggaatgaggaggaggacctgaaaagaaaatggatgaactagaacttacagaaataaaatatatagctgggtctggtggctcacacctgtaatcccagcactgtttgggaggccgaggtgggaggatggtatgagcccaggagttggggagacaagcctgggcaacatggtgagaactcgtttctgtaaaaaataccccacacccccaaaaaaaaaaaaaagtccttgggtttggggcncgtntntgtancccacntngncnggnggntgnggngggnggatccnttgnctagggggcaagggctngattggccttcccctggaaccnancctggggg

SEQ ID NO: 2017 - DNA, 718 bp, Homo sapiens
  misc_feature (1)...(718): n = A,T,C or G
ttttcgattcggcgcgagacncacngagagagagcncgagagagagagagagagagagagagagagagagagagagagagagagagagagaganaganagagagagagagagnnanagngagagagnganagagagagagagagagagagagtctctctctcttncgnctctngctntctgtcttnnctcccccccanatagagnnnnctcctcgttcctgggggngtcntcnctctctaccntctttgcgncggatctttntctnataccgggnctnctgtcccnctntgtnagntcanccnctctntgtgnccccctctctnnacgcactctcactctgtntttgtgagnnntaaagatcnatcttgtgtgggtgngngtnccctttttgctnnccttcttttnttnaanntgccttcnctnnaccctttctcncttttanatgccactctctntncctgngcncctccccnnanggcgggganatatatatgngtcccnccnnccgngcntgaaacacnngnctctctcctntggggncnggcaaggtcccctcttctnttntctnggccccccccngaaaangggcttccgggccgcccnctttggcagcccccccttncccccccangacccttggcttcgtgaagtggcgtnttgggtncagggangccccccccncncntntttccnntcttaagggcttggagattcccg

SEQ ID NO: 2018 - DNA, 683 bp, Homo sapiens
  misc_feature (1)...(683): n = A,T,C or G
gtttcgantcgtgcgaggaaaccctatgtgtgtgataggtgtgggaaggccttcaggaacagctcaggcctcacagtgcataaaaggatccacacaggtgagaaaccctatgaatgtgatgagtgtgggaaggcatacatctcacactcaagtcttatcaatcataaaagtgtccaccaggggaagcagccctataattgtgagtgtgggaaatccttcaattatagatcagtccttgaccagcacaaaaggatccacactggaaagaagccataccgatgtaatgagtgtggtaaggcttttaatatcagatcaaatctcaccaagcataaaagaacccatactggagaggaatctttaaatgtgatatatgtgggaagttatagtggcacatcccagaagagaacctatgagggagggaatgccctggatgggggcaggatgaggatgcctctgtagcaggcagagcttaccaagtctntccgaactcaaatggaagaaataccttatgaatgtaangaatgtanggggtcatggcttgtaatttacccagngtnaatgaaaccatcctagaggattattgagggaatcctttctatgtganttttcaatcatancaangcaagaaaggcttcccntgttcaaggtanttcancctnttacagggatattaaaccagcccg

SEQ ID NO: 2019 - DNA, 1120 bp, Homo sapiens
  misc_feature (1)...(1120): n = A,T,C or G
gcattgcatatggtactcaagttgtgttgcgtatnagctcacaggagngcnagttcnggattttatacatcttttttttttttttgnaaagggaaannnnctntgncccccaggnngnagngnngggccncaannangcatnanngaaanncccgncgnnannaaatatnncccnttctttggcctaacccnccnnnnnancgggaanaannnggcnnccaaccaataaangaccnggganaatttatttgnnttntnnaannannnannaanacntntnnccaccnatncnnnnctccncangaactcnccnntaacntncttaantnncntccnnttannnanctnannnngcatcnaaacatcncntcnnncacanacccnaancaataaacnnanagtggttnnnanaactaggggancangcncnnncnagancntaaannnnaattnacttcacannatcatctatntatctataacacanangctancnntattnncnntctctntncgcancnncacanctnacacatagcgcnatnctcagcncatcnnatanngtnnagtacttcacngaagancgcgncctcnacanagtatagagancatngntngagangacaananancncgatnataacagtanatcntntngtacancgnagnccncggcatatatcncaccgatcnnnngcncacnnancanatncacnccggtnagnatacaaanccanaaacntcgtnncncnctanctcaannnntaaantgcncnatcncngngtccaccncacantncgtcgtntcgcancatntnnacacgtntagcgatcntgcgcacatatcaccgcaanncganacatactatngatcgcacncnnaacnggnntnntcancgacacanctaccatncancanncgttnaagnactancanananagatggntntacncatcgnancncactgcagntcatanagnganatatatacttttatacnactctcntgantncagancacatntgcacacacanangtacatatacnnactagnacacgacatantntntatanataanncanacncactgtacacacactganatatcgcataanc

SEQ ID NO: 2020 - DNA, 1361 bp, Homo sapiens
  misc_feature (1)...(1361): n = A,T,C or G
cantaanannatannncgttncnnacttaccaacnncgtacttacgaatntnctaagntctnacaaaaacncgnacttgcagtcnnnctctntctcananaaaataancttactccncgaactntatcngcntctaacgncatctcntcatatcacncatntctcaaatctaancatagctgctnantcanttacatntcntnatnnttagtnnnatatnntncatcactcnnctcancnngtnntcncantntncgnanntcggccacnnangtnnaatccctnatggnacncccacccagctncctcnntacttnatcgtgcancntcanntaaantcattgaangatntattctacanacntantttanccnccaatnacnaaaaggggnatttnnaaantatcacacnttaacncatnnanctacntnananccctanaanatanttcactcnctntcnttcaatncnncntcaacacttaatntcntannnacantnntanntcgaacctnanctnnnntctgactgtnntanantnnncattanaaanncnncnnaannantaantnannanttctaanctnttcnaaannntatnnnnatnccttncttttntntatntnnaacnnnttacnttatattnttttcaantcacaatnancaacacatattatnannactnttaanncntnnactacaatctanaacntnatanatanannacatnanattaatacccnnnatgacncgttttnnanattatnnntatnannannctcnattnaccnanagtcnaanantcnatctncnacttncggagcnnagaataaccntaatcnntctctntantcnnntatnnncacatccatcnangtagtancacnctacaancctctnaacangcacangtaacgcnctatatntcataanntcataactnntcactacaccntncanatctnactncgntatnaatananctgactatatctctncanatngantactngancactntnatncnntnaccctcactnngatntncgcntacacgcncntaganncaacacattcngatanactcacngntntncntagcnatctcacatatctcatctnaccncncatcanncncnaatncancntnncnnanatnnctatctnatatntacaanncntttatnactcacgtcncncaaanagatcnacatttaannncatnancantatcntacacanatacatcnnattncncntccntacacnttgggatatattnatctccacgtnaganacatcgccatatctncgaatcanntnncntcatatctnatnacntacaccnntctnagnannc

SEQ ID NO: 2021 - DNA, 845 bp, Homo sapiens
  misc_feature (1)...(845): n = A,T,C or G
atatcctttnaactcnngtctttttgcaggatcnnnnnnntcgaattcggnacgaggatgcacgggcactnnggnggntttngcggccactctgagtnagancatccagntggcggtggaactgaaggnttccatgngggacctctattccttctcagctntcatgaaagccctggaaatgccacanatcacaaggttagaaaagacgtggnctgctctgcggaaccagtacacccaaactgccnttctctatgagaaacagntgaagcccttcagcaaactcctgcatgaaggcagagagtccacatgtgttcccccaacaatgtatcantcccactgctgatgccgcttgtgacgttaatggaccgccaggctgtgacttttgaaggaaccgacatggtgggaaaaaaacgaccagagctgtgaaatcatgcttgaaccatttggcnacagcgccnattcatggccgaggctgcaagacagctccggatgaatgctgagaggatctggcanggtttcaacccagatgaangaaatgaatgaaaanttgcaagacntgaatttnaaatnccaattgctttgggggcnagccaaaaggtgccccaaantccaattcaanacnncagaggattttgaggaaacntcaaccnagatttttaactggccccttttcgccgttaaaatngggaancctccccccctgntaaaagcaaggccagaacttttttantnactcttccannaaaaaccccnttnanaatattcnttttnaaagnnttcccccncctttaattnttttngggaaaaccttacntgttttttggataaaaanaatnatgtnccaa

SEQ ID NO: 2022 - DNA, 805 bp, Homo sapiens
  misc_feature (1)...(805): n = A,T,C or G
tatccttcaactcttgtctttttgcaggatccnnnnnntctnttcnnncnagggcagacttctcatccgtaaaatnaggaagataacatgattccaaggncgtnntttnggnttaaaggaagtcatgctcctaatttactgcctggcacacagncagtaaaangctcaatncattnatggaaggaatgaaggnctctggcagaaaancaggtcanatgtgtctgntgtggacaggtggctctgtcggtgcccggtgagtgccctgggagtctgcagtcacctcctccgcagccgtgtccccaggctcacaggagccacctcaggtgggaagctctctgccagccttgggaagaccagactcacagctccaagccacgtgtgagcanggagtgcttgcatcccanaaagtgtctgcctcagcaggctggagattgggatccccctatgaaatgggtgggtgtgtgggcactaaaaaaggaagattggctctgtttcaanaaacttttaaaattcactgtactggtttttattattaccaaagtaatgtatgctgattatagaaattttaccccnnncccncntnccnnnccncnnncnnnnnnccnncncnnnctcnnccnnnnnnntnnnnncnccnnnnccccnnnnnaaaanccccncccccttaaaaaatttgggggggccttttnctcncnnccccccccctnnaaacncnccntntngggnnntngggccccccccccctcttgaanccgcngggaaaaananttttttttttnnaaaaanntcgngnacccnnntcttn

SEQ ID NO: 2023 - DNA, 1335 bp, Homo sapiens
  misc_feature (1)...(1335): n = A,T,C or G
aggggnggnggngaccntngggngnnnagcgggggccnncaaanccanancnatngggatctgggcccactcncnnnnncgatcncttatncgnngangtaggaanancggnagtnaaacnccgccccaacgagagangacgggggggggnttntttctatgtctnncgaacgcnnngncncccnccntatctnccgcctccntancacacatatgtaganncactantncntactacancncgccncatnnnngcatgnnngnganctncgancnngncacacannggggntngagtacncanncgggangataagngcacnantngngccatgnncnnaaaaccggacntggcgcncccanngacaccggagagtnggcctgncaacngncgnacanagngttgctntnnangccccgcanacncttanagcacngcaccnagaggngangcgggaacacaaacgngnacccgnngancgggagcggatnganngaaanctcgggaaaagganggnancaatncnaancagngtagngnggcnccnnncnccnancncngtangnacctgannnccgtaccactncncgccatgtgaaaacgtnngagtnnnaagacnacggnngcgganangnatcnactccgccccgntnnacgcgcgacgcacnnagactcgannccgcgcaatggncgcangnnaanncncctgcgnngntagacatgagcgaatgannncacgggcagatacacangntngcncccgggatatngcacccccanccnatnnncctnnncgccgcacganntancccnnncggcgantcaagatgcnctatccncaacnaanggnccnncnancatngantnnaananagagncngtatatctnctnagggaaagcaanatncacacaagacgnancgnntgactgccaccaccgtgngacacannnntncgatancgctnatnccnntacntgnnganttngcntncatntgcgcggaancncgactnntaatgaancncngccgcngcnnatancncacggaaccgcaatacggnnncgcgtacngngacgagagacgccganatannaccgccgaatggtnannacccantngntgncnactnnaggnncnacccncnacngtggtgnnctcgcannaagatnncgtntcgcccnntncncnnccnncccntgagnatgcgancgncccacggaccccgccnacganacanncgnnccnccntcaaaaacncgncngcgcnnnccacnncgcncgngnngtgnanangtacagcntttaccgcggaagcnggnnntntntnagagn

SEQ ID NO: 2024 - DNA, 877 bp, Homo sapiens
  misc_feature (1)...(877): n = A,T,C or G
ttancctttnaactcctgtctttttgcaggatnnnntnnnntnganttnnnncgagcctaagcaggcntctgcagcnttttntttccagaaaagaaattctcaaactaatntnaactgaggaagtgaaagaagaaantcttaaaantgtnttatctgaanccccanctatatgtcctcctcaaancnctgaaaaccaaaggccaaagaccgggttccagntgtggttagaagaaaatngaagtaatattttgtctgacantcctgacttttcagatgaagcanacataataaaagaaggaatgattcgatttagagtattgtccaactggaagaaaggaaaggtgtnggggcttaaccaaagcccaaagggagaaaacggcnaaggtngaaagggaacctggaagccaaaagnaagccgaaaaaccgtggtnggttggatggaaaaggtggatggaaaacacnaaaaacccngggnaaagaaaaaangccaaaaggagaaccctggaattttggttcttaaaaagccaagaaaaccctttaagattttttcttaccaaattcanaaaacctatccagctttttgcctttttaaagcagggagttaaanggaagaaagtgacccctaggggaagtcatnggattttttttttactcnnctttttgaatatagactcgagtctttggggaaacntcntcttttatatttctnttaaagaagtttggaagccncctgtttggcctttataagantaangnagtaattatattggnngtaggntacnnggcntnttgttnaaacctntcatttttgcanaattcttctgcctccaaattgcngggncttncanagatgcnttggggattgcanttnctgnn

SEQ ID NO: 2025 - DNA, 708 bp, Homo sapiens
  misc_feature (1)...(708): n = A,T,C or G
nttcntnggctgcttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtcaggcagttcctgctccgactggggctcctccaggtggtcagccagattatagtgcagcctgggctgagtattatagacaacaagcagcctattatgcccagacaagtccccagggaatgccacagcatcctccagcacctcagggccaataataagaagtggacaatacagtatttgcttcattgtgtgggggaaaaaaacctttgttaaatatatggatgcagacgacttgatgaagatcttaattttgtttttggtttaaaatagtgtttccttttttttttttttnnaaagngnacaaaattttnatcnntcnngtnggggggttaatttttttgngnaaaaannaaaaatgggttngtttttanttttanagggggaaaangcncnctttccncccaaatgggttttngcnaatttantgggggnggnnncgcntttgggnaaaaaaaaaaggnccnntttttaaaaggggnaaacnttccccnttttaaaaaaangcccgnnttttgggngntttaaaaaaaa

SEQ ID NO: 2026 - DNA, 673 bp, Homo sapiens
  misc_feature (1)...(673): n = A,T,C or G
gtttcnctgactnttaccttcaagtatggaaatnncagtgcttcaggaatagaaatcttggcaatcgaaaggtatttgattccaaatgcaggggatgcaactaaagccataaaacagcagatcatgaaagttttggatgctttggaaagttaatataaaagaaaattatataaaaagaaattaagacaaccaagagaaacatggacatatacctcctgactgaatactaactggagacctttcatttgctcatggggctgcttaaatagcaggtctaagaaagtgtaaattattataatcaatctgtggacagtaaactttttaaaaatttttcttctgcattttggttttataaaatgatgtattataaaggtcagttattaaattactttgaagtaactgaccctgtgcccttatggactaagtaagggtacagaatgcagttctgttttgaagagctgttttaagggaacatgcatcactttcgggttcaaaaacaactgtacacatacatatctgcagtgtcttcactgaaaattagagatagaattagttgaagagacttccttaattgctacattgttttactcactgagcaatatcagaaactaaaaacatagattaataattcactcactggttctattcttcttaaaaagagtgaaatctttta

SEQ ID NO: 2027 - DNA, 678 bp, Homo sapiens
  misc_feature (1)...(678): n = A,T,C or G
ttttcgaattcggcgcganganngctccacgtgtagctgagctgcatgcaccaggcctcagtttgccccaagtcccctgtgtactctctcatggcctgtggccaagaaatgtattctctcactttggacttaggagtccaaagagaagcccagaaacaaaattgcttgaacttgaatttgtgtgcgtgcgcacgtgtgcacgtggtggtgaaggtgtatgttttcggctgttctatgcgtcactgtcaccaaactcccaaataatagtaacatttgtttagatgatgtctgctgacaaatcacaaacacgacgctaactcgcaactctctgctccactggcacagaatagggcatggagcctggtgctgggtgtcagcccatggtgttgggtgtcagttcacaggctgggtaagggagggaaaataatccattctttgatattagacatgacccaaaatttcctgctggcagccaaaggcctcctcgctcagagaagtcatctgaaaaaagctagcccaggggcaggaaagggcctcangctggcgccccaaaaaggnggcccatcagtcactctgggaagacagatagacatcgtcaggtctctttttacaagtcaagacagtaaaatcaaaagtaatagtttctggcaggaanaaanaaaattgctgganccgttg

SEQ ID NO: 2028 - DNA, 698 bp, Homo sapiens
  misc_feature (1)...(698): n = A,T,C or G
nntttcgantcggcacgagncagtcaggcgatgnctgnctcattgccttggttctcacctcagagactagtgtttcaccattaagtgtgatatagcttagtnttttataaatacttgggagtgaatttttaactgggtcatagaggattgttggatttcagcaagtagaaatcagtggaaattagttctccagacacagggaagagacactagtagtaaaacaaatggtctcctttggctatagattaaagggagatagtggaacacacacatttgtcatgataaccctggctcaaagatagaagattaaaaaaagttatgatggggccaaatcatggagataagacagttgggaataactcttctttcagcgctaggaggagaatggagccaacatcaacagaattagagaagtcatcaagaaaagttagttatgtgaaggaatgcctcttgtggcaattttttaaaaattgcattttatgatttggaactcaccgtcttaaaataattggctcttagaaatggtgtactgctacttaaccagaaaattcaggggcaaaaggggtaaatggtggggtatcatttacatggttgggagggacatgtatgaanaagtttggaagaaaatgttttggantaaagaataaatttaaattctgctaccttggggtctggggacatttgggaaaatttggttt

SEQ ID NO: 2029 - DNA, 802 bp, Homo sapiens
  misc_feature (1)...(802): n = A,T,C or G
ccnttgagnactangggncttnngaannnnccantcancatgaaactntntggcttgcaagacagggcaatagaggggaccgtcacggagncaggcccttccacactntggcgtgcagnantgaagcacggncacnggccctgcctacacagagccaacctntgntccnacacccctccactgtaaaatgagaataagcactcaggatggtttgtgaggattcactaacagactgagaagaaatggtnacctaggctggcacatgggacactccccanttnntcttttttattttccttaagcccagnntnaancccttctncntccttnggtttcntgacangccatttcnntttaaattttcactttcanaantttttaaaatnnnncnaaatttntttnancatntnaatggattnataaaaangtnnaaatttttcatagtattaaantnntnntttcggncccntntanttttntaaacaaaanaatttctccntttnnttcntaaaataacccnntttttcatattnncccnttngcctttttttnantttttcttcnnnnnanntntanccnttgnttaacttattntttttnnttccccnanntttataagtttttgtntttntgtcgtactcncntnnatnattcntngtnttagtcanttttcnttttancttnantgntcttnctntttccccnnatttcttttnttnnattnntannaaanncatatttnntanntntatncctctcnctccctttaattaatcnactcnccnncctncntntttagtnc

SEQ ID NO: 2030 - DNA, 822 bp, Homo sapiens
  misc_feature (1)...(822): n = A,T,C or G
ngtgacattgaaggntcngccaangaaaacaagttattaatacaaatacgtactgaatatgacagtacgcattaggaatgctgtgntnnaatgcataaacatgtttacagtggtccacatgtgccaggagatgtgggaatggctacccntgaaaaatgctacttaaatggggtcctcatcgcacaccatacacanacatcatctcacaaatggattaaagacacttaagacctgaaaccaaaaaaactcctaggagaaaanacaggggaaagctccatgacatcnagtttccgncnaggattttttttttngacnntnacncctatngaaanaannatnccatacntattntncngnncnaatccnatnnncnggaaangccttttataagcaatttngcccntttttngaactntatgcataactttgnncnaancnttcggacaaaantggttaantngttnctccaantntaaaccccctcttattggaantggtncccaccaaaaaatccctnggaaaacccncttnaataaaacctgganngtnccccangncccaaaggccacaannggggcgtcaanggcccttgnaaantcccnaaaccanattttnggaaaggnnttganngtccggnnnngnanntgncccggaaaantcggngannngttannnaaacccnncnctnntccnaanantnggggnnaaanccccccgtctttttatntaaaaaattaccaaaactcnatttaggcttgggggngggggggcaanntngccctgnggggtccccaaatcnacntggggaagggntnnaaaccg

SEQ ID NO: 2031 - DNA, 674 bp, Homo sapiens
  misc_feature (1)...(674): n = A,T,C or G
nctttcgggatctgcacganntttnnntcatctggtttttgcatgtttgatgtgtttgtgtgtgtgtgccgtttacagttttaactgatattaagtgaagatagattaatgtcacccaggttttacaaaatcaaagaaatagaaataattttaaagacttttggtacttgaattactttgttgttttctggtcatttagtacatttatggaacctcagaaggtttgagttgaacagaggcaagttacagcagttttttgggtgggagaattcataagtcagcatgtgaatcttttgatctcatatatttggagtggaatgtcattaattgtgtttgtcacggttaaggaatagagaattaatctccatcccagtcttgctattcttctgaaagcctttagctgccgacaccatgggcataaggaggtatctcttctggcttctctttgggtgtggtagctaagttacagcttaccttggaaagatgagcagcttgtaagcaacaaaaaaacagtatagttaacaaatgcatcgtcaacaaacaaaacaacccaatcaaaaaatggacaacagctttgaatagacattctncaaaacaaatatacaaatggccaataagcatgtaaaaagatgctcacatcattaatcattagggaaatgccaattaaaatcccg

SEQ ID NO: 2032 - DNA, 698 bp, Homo sapiens
  misc_feature (1)...(698): n = A,T,C or G
tntttcgaactatgttagttgtncccacaggtgcaggccctggtgcttgatggtccgaggccatctcctgggccgcctggcggccatcgtggctaaacaggtactgctgggccggaaggtggtggtcgtacgctgtgaaggcatcaacatttctgggaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttngctggaagtaccaggcagtgacagccaccctggaggagaagaggaaagagaaagccaagatccactacccggaagaagaaacagcttatgangctacggaaacaggccgaaaaanaacgtggagaanaaaaatttgacaaaataccacagaaggtncttcaagaanccacgggacttccttggtnttggagcccaataaaagaattgtttaatttcttcaaaaaaaaaaaaaaaaaaaat

SEQ ID NO: 2033 - DNA, 673 bp, Homo sapiens
  misc_feature (1)...(673): n = A,T,C or G
ttttcgattcggcacgagcttaatgtttttcaattgctcaacgaactgtcagccctgtcagatatcatatatctggtaaaattaccccttaggaatgagggggaaataaatacatactagatgaaggaaaactaagagagtttgttgctagcagacctaccctaaaagaaggctaaagaaagttcctggctgggtgcagtggctcacgactgtaatcccaacactttgggagactgaggcctgccaagctgaggccaggtggacagcttgaagcctggagttcaagataaccctgggcaataaagggaggcctcattctctatttaaaaaaagaaagtcctgaaacataaaggaaatcataaaagaaggaatcttggaatattaggaaagaaggacaacaggaaagagcaaaaatgtgaccaaatacaagaccgggtatgttgactcacacccgtaatcccaacacttagggaggttgaagcctgttctcaagaccagtctgggcaacatggcgagactcttgtctctacaaaaaataaattanccangcgtggtgtcgtgtgcctgtagtcctagttactaaaggagcctaaggcagcaagattgncttgcccaggaatttgaggtattgngagccatgatcaatggcactgcactncccctgggtggagnn

SEQ ID NO: 2034 - DNA, 677 bp, Homo sapiens
  misc_feature (1)...(677): n = A,T,C or G
ttatccactctcaccagcataatgggacccagcatccctgccaaaactcgggaggtgctcgtcagccacctggcatcttacaacacatgggctttacaaggcatgtatggagtttcttgtgggcttggcaggtggctgtgaaggccatcagtgtctgaagcctgtacttgcccctccccaggtcctgtgagtggagaggcacagagtgttctgggctagctgagtgtggaggctgggtggctctgatgctagccaatcactctacgctctaggctcacacctttccaccttcgacttcgccagcagaagtcttgagttcaatctcattgccctggcttgggtcacatgtccatccatgaaccaatcactagactgggtgcggaaagctctgatttgccaagttcgggtcatgtgtctcactaggtaagagcagaggaggatcacccccagggaagaccagagtgctctttcaagaagagtgggacaatcgctggatggctctttgcaccactcactcctgttctctgctaagggcttgctgggactcacaaaggggtaaggttgtggcaactgccctgttttggggttcttgactttggcttgtgtccctgcagggaatgaagtttgtanctgcccactcaanntccatggngctaaccttgggcctgaatganctg

SEQ ID NO: 2035 - DNA, 670 bp, Homo sapiens
  misc_feature (1)...(670): n = A,T,C or G
ttatcaattcagcncgaggactctttnntcctttgcattttctttctcagtctgatctgcttcctgacttcctggaaaccctccaaatttcttgatttctaatggcactctttctagatttctagccctgtacgataatattctttcatcatttcagtgggcttttggagggaggcggagatccaggtgatctgtctacactattcagtcagaaagctggatggtttttctcactgtttagctgtgactcatacttagaaagtggtttaaatgtgaatatcttagttctggttgtacaattgaggtaatcctcaattcaggttgctgtctggacatttcatgactggatttaaaaatatttttaaggccaggtgcggtggctcatgcctgtaatgccggcactttgggaggccgaggcgggtggatcacctggggtcgggagttcaaggccatcctggccaacatgctgaaaccccgtctctactaaaaatacaaagactatccgggcgtggtggcgggtgcctgtaatcccactactgtggaggcaggatggatcacttgaatcccggangtgggggttgcaatgagcccanaaccgtgctgctgccttcatnctangtgactgagcactacttcattctaaaaaaaaaaaaaaaaactcggcctttta

SEQ ID NO: 2036 - DNA, 682 bp, Homo sapiens
  misc_feature (1)...(682): n = A,T,C or G
ttttcatggaatttacttttcttctagactttcttttgcaatggaacgttgctttgtgtgtgatttggtggaataacaaccaatacacaatgagcagtctaatgtgtagtcatttggtgctctgtgttcaagtgtgaaatctctatcagtgcccaatagtaagccagggtctgcttttcatatagaaaatggttgctgacagaagaagatgtggccgtactccagggtggttctctatggaggcttgtgagagtctctatacagcatccatgactgccaccggcacttccaataccattagttatcctggtaataagagtctcactcaaaagtagcaaccttacaagttaattaaattggtcatttcagctcattgagctgtggtatctgtcacctcaaaaatgcagaggcgctccaagtcttgcacctccttgcaatggtaacatttgggtagagctataaatgaagtgagaaaacaagcccnnnnaangaaaaaaananaaannangggaaaaaaaaaaaannanaannnccccccccnttaaaanttnngggggggggtttttccngaaacccncnttnnaaaaaaccctttgggngnanntgggccanaccccnccntaaaaanannnnnnnnnnnnnnnnnnnnnnnnnnnnnnnnnnnnnnnnnnntnnnnnnnnc

SEQ ID NO: 2037 - DNA, 670 bp, Homo sapiens
  misc_feature (1)...(670): n = A,T,C or G
ntatcattcgacgagggcaaaggaactaaagaagcctaatgaagacatgtgcttagcagaccaaaagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacaggatacaaggctaaaacagctcttggagaacatttgctgaatgttggtgtgaatcgagacaatgtttccgagattttacagatatttatggaagcccactgtggacaaactgagcttactgaaagtctgaagaccaaagcttttcaggctcacactccagcacagaaagcttcagtcctggctttcctgatcaatgaactggcatgcagcaagagtgtggtcagtgaaatcgacaagaacattgattatatgtcaaacttgaggagagataaatgggtggtagaaggaaactncgcaagctcagaatcattcatgctaaaaaaacagcaaaaaaacacttcaggtggcattgatctt

SEQ ID NO: 2038 - DNA, 677 bp, Homo sapiens
  misc_feature (1)...(677): n = A,T,C or G
gttcattcgcacgagggggtttcaagaacgtgcctcttgggaaggacgtccgctacttgcacttcctggaaggcacccgggactatgagtggctggaagcactgcttatgaatcagacggtgatgtcaaaaaaccttttctggttcaggcacagaccccaggaagcttttcgggaagccctgcacatggacaggtacctgttgctgcacccagactttctccgatacatgaagaacaggtttctgaggtctaagaccctggatggtgcccactggaggatataccgccccaccactggggccctcctgctgctcactgcccttcagctctgtgaccaggtgagtgcttatggcttcatcactgagggccatgagcgcttttctgatcactactatgatacatcatggaagcggctgatcttttacataaaccatgacttcaagctggagagagaagtctggaagcggctacacgatgaagggataatccggctgtaccagcgtcctggtcccggaactgccaaagccaanaactgaccggggccanggctgccatggncttcttgcctgctncaaggcacangatacaagtgggaatctttgagactnttttggncatttnccatggnttanactaaacttcaagccctttaggaagttccaagggaacactttgaa

SEQ ID NO: 2039 - DNA, 677 bp, Homo sapiens
  misc_feature (1)...(677): n = A,T,C or G
aggtgagcctagggacccatttctcctcctttgacagggacatcagtggagccttctcagacccacaggggtccttggtgaattttgtcatggttatttaaggaaccttgcctagaagtcccaacttgcagttccccatcgacgggaaggcttggactccaagatgattataaaggaatatcggattcctctgccaatgaccgtggaggagtaccgcatcgcccagctgtacatgatacagaagaagagccgtaacgagacatatggcgaaggcagcggcgtggagatcctggagaaccggccgtacacagatggcccaggcggctctgggcagtacacacacaaggtgtatcatgtgggcatgcacattcccagctggttccgctccatcctgcccaaggcagccctgcgggtggtggaggagtcttggaatgcctacccctacacccgaaccaggttcacctgtcctttcgtggagaaattctccatcgacattgaaaccttttataaaactgatgctggagaaaaccccgacgtgttcaacctctcttcctgtggaaaagaaccagcttgacaatcgacttcatcgacatttgtcaaaagacccttgttgccccacaaccgaggtnttaagaacagaaagaaggacccccaagcttgttncaagtncaaccaaa

SEQ ID NO: 2040 - DNA, 686 bp, Homo sapiens
  misc_feature (1)...(686): n = A,T,C or G
ttttcgattcggcacgaggggaaaacaaaaggtaannggaggggtgctgggagaacaaataggaagaaaagggaaaacccagaaatagtaattgttagtacccctgctacttgactgttgaaaatgctttaaaagtttgttctgaattangagaaaaggcgctccctcaaccaggctgaaactaccaccagtgttgttgccagaaacctggagcaggaaggagctgcttctcccctccgccttccagtcacccaccattaatacctgctattggcaaggcccatctggatggcagatggcaaagcancctggaaagtggagtttaccaacttctacctcctacagtatatagtggagcacagcnaantggaaaaggaggccgggcgcggtggctcacacctgtaatcccagcaatttgggaggccgaggtgggcanatgacctgaggccaggagttcaagaccagcctggtccaacatggtgaaaccctgtgtctactaaaaatacaaaaattaactnaacgtggtggtgggtgcctgtaatcccagctactctggaggctgaggcaggagaattgcttgaacccgggagtttggaagtttgcaatngagcccaaggtcacgccactgnactttcanncttgggcaacaaagccanggaantncntctnaaaaaaaaaaaaaaaaa

SEQ ID NO: 2041 - DNA, 710 bp, Homo sapiens
  misc_feature (1)...(710): n = A,T,C or G
tnnccggntgacnttgcccatgatggtgcctncccctgatatctggagagatnataaaatacattacagttagagtcaacaatcaccacttgaagaaatnncttnaacacaaagcctgataaaatttacatctggtaaatgtctatttaagctactgcgaaacacatatacttaaaaaaaaanggccttttcattgnctcaatgtcttgaaggctggagattgtaaagcacttccctaaagttcctatgagcaggatgaggctatttgcctttatagagctntagaactaataagcaatcaaaggggattttgaaaaaagcctataacttccaaagtgataaactgnggaaanattcattggacctgtcccanattanctgaagtatccagatgctaaagctnatgtgtanaggccaantacggnggctcatggctgnaatcccncactttggaaggcccgaggcggncggatcaccctgaggtcgggaggncganaccactcttgaccaacatggagaaaaccccgtntctactaaaaatncaaaattctccanggcgtgggtggccgcatgccctttaaattctnnagcttcttnanggagggcttgaggccaaggaaaaatttgctttgaacccccggaaanaaagggaaggtttgccggtganccntaaaataagccnccanttggcncntcccaaccctggggcc

SEQ ID NO: 2042 - DNA, 1022 bp, Homo sapiens
  misc_feature (1)...(1022): n = A,T,C or G
cntntcgaattcggcacgagaattgatttgctacntgccctagnaatgatacacgtatgcctcagtattgccaccaagntaccnctgtgttcttntaanaatgagncntnaaggggggnanttttgaaanngtaatanaaaataccnnnanatgtncnangntatnaaaangagtananncccnantaanacaaananttgtatatnttttcttnnntnttncnnnntgannnnncgnntaanttnnnnagcntncaactntanngntgtnancnttcntatanngntnatatnnattngntaatcnttcattttnancaacttatacaanagntcanttacntatggannnatnttantnnnttnnttattaancagncntanaanncnnnnnnnagnnnntnnatnntatttntncttggtntcngtctctaatgtcatanngcttgatnnaccnatnattnnncnaatttatgttnatcttnttcatacnaatnttttnnannnacangtcantaatncattttctattngtncnaatanntcttcactannatncatnnantntnnntacatntnnatntcngtgnnctcnctntactnnntnatttnangngnatnganaggacattatnntatttnnnaattcntncntntgtnaacaacangatataagtntnnttataanantcccnatncntagtntacganatgagattattagctgtgngntangatntattntntantatanacncatncaacnttctgctanntanncatcagtntatncntnntntcatcgcgctacctctntnnccacaantancnctatngtnnnnntatntcgcaatatatacatacncgttcaacatncacngnctaanngaantttcantcttcgantancatnnnnaattntatctntcncattttatcacgatacttctcnacnctgtcatnnnnantnttncaatatgntntgctacantnganaacgngntatnctggtcacatcnncg

SEQ ID NO: 2043 - DNA, 681 bp, Homo sapiens
  misc_feature (1)...(681): n = A,T,C or G
tnttttcgaattcggccgagaattgatggcagtgactgccttcggctttttttctgctgactaagatctcctatagagagctacaacaatgcccaaaagaaaggctgcaggtcaaggtgatatgaggcaggagccaaagagaagatctgccaggttgtctgctatgcttgtgccagttacaccagaagtgaagcctaaaagaacatcaagttcaaggaaaatgaagacaaaaagtgatatgatggaagaaaacatagatacaagtgcccaagcagttgctgaaaccaagcaagaagcagttgttgaagaagactacaatgaaaatgctaaaaatggagaagccaaaattacagaggcaccagcttctgaaaaagaaattgtggaagtaaaagaagaaaatattgaagatgccacagaaaagggaggagaaaagaaagaagcagtggcagcagaagtaaaaaatgaagaagaagatcagaaagaagatgaagaagatcaaaacgaagagaaaggggaactggaaaagaagacaaagatgaaaaaggggaagaagatggaaaagaggataaaaatggaaatgagaaaggagaagatgccaaagagaaagaagatggaaaaaaaggtgaagacggaaaaggaaatggagaagatggaaagagaaggngaagatgaaaagaggnt

SEQ ID NO: 2044 - DNA, 649 bp, Homo sapiens
  misc_feature (1)...(649): n = A,T,C or G
ngagaactanggnantganannnnnnantnnantgncctntcngnatgcnnnacagggcagagaggggacgtcagccccaggcccctccacacctcatgtgcagttctacagcacgggcacaggcactgcctacacagagccaacctctgagcccagacccctccactgtaaaatgagaataagcactcaggatggttgtgaggattcactaacagactgagaagaaatggtgacctaggctggcacatgggacactccccaagatgctcctttttcatttccctcaagcccagagtaaaccccttcgacctccttgggtttcgtgacaggccattccagtttaatttcacttcagatcttgaaatgtccaaattcttcacctggaggatagaaaggaaatctcaggataagtttgttggcctcatttgaagaaaagtaccttatagaagagccataagaatgacgtggctttcattcactcagcagatacattgggaccatctcttgtgcccaccttgagcttggttangggtacanganatggggtcnggcacnctgggaactaangaggtctgaacccacctgggggatggangactgnctggangtggaggccaaactgaatgaatcacacaggctaagtgggga

SEQ ID NO: 2045 - DNA, 654 bp, Homo sapiens
  misc_feature (1)...(654): n = A,T,C or G
ttgncnattcngcacgaggnganatnnaaggntaggccnatgnagangaggaaatgaaggctaaaggtcatatatctacaaagtggggaggtcagactttgaacccacaacctgactgtggagccacttcagtatactctctccccataagaaagttccaatagaaaaaaaatgctacttaagtagggaaatcacaaaataagtgccaatgaacaataaatgttcaacctcactacagttaaaatgtatattaaagcaagagttgagatgacacttttccttataaaacagacagggattcagggacattgggactctaatgctgctggtaagacatgaataaatacataccatctctggcaatcaataccagaagctttaagcattgccttttgactttgaaattgtacctggaaatgtatgtttcagtaaccatcatgaatgtcacaaaatcctgaaactcttaaaactgatgtcacaggccaggcacagtggctcatgcctgtaatcccacactttgggangctgagcgggtggatcgctganatcgggagttcgagancacctgacaatatggngaaccccgctntctaaaaatcaaaacaattactggngtggngggatgtgcctgngnccaactcttggagntgnang

SEQ ID NO: 2046 - DNA, 708 bp, Homo sapiens
  misc_feature (1)...(708): n = A,T,C or G
ntttcgattcngcgngagagatggctcttaagacactcaataaatatacttattgaattagtagaacttttcccatgnatctcctattactacattaggatctttgttcccttagtgtgtctttagcctgtgctctcacaagctttgtggtgtcgtgtggatcacaggatcgtttaagataaagatacttttagctctttaattctggtattctattattggtacagggaacccatacattatcttaatttcagagtaacacacgtctcggcatgggacagggggtgtcctaatgaaaagagggctaacaggtggaatactgactatgtgcaggcactgtataaagcaagtagtttttaaatcccatttgcaggtgaggaaaccaaggctcaaagggattaagtcattgtccaaggctatgtagttgttaatgagtgaatctgggttttaaaataaatgtgttaaattccagggttgatatttgcactgggcatttatntacttttatttgaattttttttttttgcantttactngccngccanaatttntcntttgttcaaccaccaaaacatttttggttccccacttggctttncccactttggcnttcccctantttnacanaaanggggggggaaaanaaaacgnggggggacgggatnttntaaaccccctgtnanagganccacaaggggnattggcttn

SEQ ID NO: 2047 - DNA, 676 bp, Homo sapiens
  misc_feature (1)...(676): n = A,T,C or G
gttcgtacccccatacnctccgtcccccgccggcctaccactatctagacacctcctgccctctccatatggctccgggggantgtttccctccctagnccganttctccaatnnacagcaacttcctgcttctccagcaagtcgcataagaagaactggaatcttgacactacaactcctgacaggacgcccctgcggcatccagagacagggaagccagtgctgctctgcatgttcagggcgagtagctgagagtctccttccggcctggatactgaggaaggtgacttagactttctctccgtcctctgagtcgtaacggacggacacgcaagggccgaggacgggtacaagcagcagcgactagaactgatctgggtgagatctaggcctcagcaacaactgacgcaaaaagattttgttctaggattggctacagctgaaactaccgcgcttgattcaaagctcggggcttgcagcgggaggcagctggctcctcctctgaacccgcccctttggctggcccaatccgctgatcccatcctcttangccctgccccaaacttccaaatctaccagaattaatgcttccagcgcttgtttgacccactcctgcctatgatttgntggggngactaactactccgggggggggncccgcnattagaacgcttt

SEQ ID NO: 2048 - DNA, 656 bp, Homo sapiens
  misc_feature (1)...(656): n = A,T,C or G
tatcccacacctgctgtgctgggaaggccgaggatgggggcccagcactgtccaggcctgctggggcctggctgggagtcctgtgggcagcatggaacatgcagctgggcttcctgtgaccaggcaccctctggcactgttgcttgccctgtgccctggaccttttcctgcccttctccttcctctgctcccttggggctaccccttggcccctcctggtctgtgcaaactccctcagggagcccccctgccctgtagctctcacttaacttcctaggggctgctgagcccacccagaggttgttggagttcagcggggcagcttgtctcccttgtcagcaggggcgtaagggctgggtttggccatacaaggttggctacgccctcaatccctgaccgttccaggcactgagctgggcacccacggaaggacatgctgtccanactgtgatgactgccancacaaggcatctcgggcttggctggtcttgcgangccttgccctgtggaactctgggttcctgttttctcatctttttgcggcttttgctgtgggtggganctgccgtattcagcttgtgtcggncactaaangaggctgtggtgcgancatgcaagaaactgccttggaatgggccctctctgggctggcctcn

SEQ ID NO: 2049 - DNA, 669 bp, Homo sapiens
  misc_feature (1)...(669): n = A,T,C or G
tttcnttggcntaggaccantgacttccctgcacgttcagctttctcctttgtgaaatggtaatagaagcacgctgcacttgggattctngtggattacatgtgagggtcttagaaacacttgatgtgtaagccaactattatgtattactgtatatggaacacaagggatgtagccaaaactaaatgcaagtttgtgcctcagatgtcttcctatcagaacagagtcaaatccagattttgatgcttaaatgtgacagcttattcagatttagaaaaacttttggtatgggccaaagaaaacatatccttaaggggatatggcccctaggccctcattttccttttctgctgagcaattaaaaaaagcattaagtaaattccacaaattctttggaatacctagagataaacagatatcatgttaactgtatgataataagttagaatacttgcaacaaaatgcagagttttctaggaaaacaagtaatcattcagaaataagaatatgaatagttcctcagttctccccctttgtggaatttgtgcagtaaatgctgctccaaagctctgtggaaaacagaagcttnccatgaaaaatctgacaagggtatctctcaaaaagagagctgtaatnccancactgtgggangctgaggtgggagtattg

SEQ ID NO: 2050 - DNA, 674 bp, Homo sapiens
  misc_feature (1)...(674): n = A,T,C or G
natcgcggcggcggtggtggcttgtggtgcggcctcaccatacaggaacagggcagacgttagcgtgagtgatcactctcaatcccggggacctggtggccttagtctttcaggtggaacggtgtgcgacatgggaaagaaaaccaagcggacagctgacagttctcctccacccctgacaaccactcaccattttactacttctatctttttgactttccaagaatgtcctagagttggagtggtacagtatgtgggtttccagactggcttctttctagcattatgtactttaagttccttcatgtcttttcatggcttgataacttgttttttaaaatcagtgaatcagatttccttgtatggctacaacagtttgtttattctttcgcttggtgaaagacatcttgggcacttccaagttttggcaatgatgaataaaattgctgtaagtatttctgtgcaggattgtgagtgaacttaagttttccaaagtgactgtacccttttgatttccactagcgatggaaagttctcgttgctcctcatctttgacagcatttggtgtgtcacctttttgaattttaaccattctaaacagcttatctgcccctactgnggaatgatgtgacagacatagaatacacttacngtggattctagttcaaaatgag

SEQ ID NO: 2051 - DNA, 673 bp, Homo sapiens
  misc_feature (1)...(673): n = A,T,C or G
ggtcgncctatcctccccacctgttagaattctatttatctttccagtcttagttcaaataccacttgtttctatgaaactttcttaactttccaacacaaattcacctcttcatttctctattcccttagcagtttgctcataactttattatataatgattgcactccaacttggatcttagctaattacgtacctgcattccacactagactgcaaacttgaggaagatgggtgctgtggctgccctcaaaccgtatgtgcctcccataggacacaagagttggttatgcaggtgttgtctagatgaaattatatagcatctatccttcttgaattggctttttgcctcagcacagttccggggagattcagcgaggctgtggtgtgtactaatcgttctttccttcataaccaagtggtgctccgtggtgcanaggtgctgcatggtaaccatccacctgctgagggactcggtggtcccaatttggggctattctaaaataaaactgggggaacattcatacacaagattttggttggaacataagtcttcatttcttttgggatgaatgggcangggttcaatttttgggncttatganaagnatatgtttaagttttaaaaggaactctcaaaccattttncagaacaaaatttgacattcacagt

SEQ ID NO: 2052 - DNA, 1282 bp, Homo sapiens
  misc_feature (1)...(1282): n = A,T,C or G
taaaantanccanntncaatttnnannnnnangnncatnnnnttgttcacnttantantnnaccatnntacnttactccantnnnnnnacaantattactatatcacatccacgagtatcactaanncactcatcacanngcgnagnacgnctnaatgcnntatcaannattatattnatctannntcncatnatananacangcanagaacananncncatnnantnatacatanantntctatanancagatagntnaanaantggggntgnnntaccnacngtaccnccnntcctcctttgacagggtacatcantggagccttctcagtacccacaggggtccttggtgaattntgtcatggttatttaaggaaccttgcctagaantcccaacttgcagttncncatnnaagggaaggcttggactccaanatgattataaaangaatatttnttgncctttgtttangnntgcacttgancntcctnacgntnactcttcnctagatncnnnnnannagcccnaaccnntcaccntnatcntcnngantcngannntctacactctncnattcaatnttcgncantcntnggacacgntgntagtctanttangcnttnntnattnnncnanantnancantantctnnncangtnnacaatnccccaaatcnagngtnatangantttnantccnntnannnnaaantnaancacnncnttncnncatattanntannnaanntataatatattnnnacaagnntacctattancanattatnacacnactngnnaccccatatatctatnccntacnnntcatanttctagacaatcttcancnctattacncatcatcancctatgtcntctaancttatnatnntcanagactannattaanttanaganatcntatacatatncnatcctcanctaatcatatgnnannnactctncancatnngntcatacttntaccatatcaactnnatcnntnagttngnanggatantcntaantntccanatcnantnnanacanactctacttcntatntntagatctnacaancgtttactacanatgntcacatncnnanctcncgaaatcnttccatncactntacgnattctccnnatatatctcacatactcacacacacactncatanacacatnnctctcntatacatttcatacatanatanttactcnctctnatcccnttngncannnacctctncatctacgtatcgctcanactctttctcc

SEQ ID NO: 2053 - DNA, 726 bp, Homo sapiens
  misc_feature (1)...(726): n = A,T,C or G
tttcattcncncgagggtatcanaagccaagcccgagctcaggtgttttgattcacagccctttataaccattatcattttgaatgaaaagtaaatcactgnttcttagtgatttgggcatgtttcctgagttaagggatctgtctgacatccgtggtaagccttgtcttangtganttgnggntaaanacttgtcccagatggagtgggaggacatgaaggatgaggaactaccttcaggaccttccagtccataggcagaggtgggggaaattcacagaaaaacaaatgagttaaagggatactgcagtagtgctgggaaattcagagctgtttaagacctancattncccctggtaggaaaggcaatcaaacacacatctgactgtcagactgcaaagttctacagcggaagaaagaaaagggtgattgtgaaatgaatagactttccacagaggaagcagaataaccagtggaagtggggagatccncattttggggaaaggaaagagccatgaaaaaaagaaggtagaggccncaaaagtaccaagggtgtgcttcaaanaaaanacttggggactttttgattgtgacttgggacttggganttgaaaaanggtgccantnggaanttggnaaggggttngggaaggntgaaananttgaaaganccangaaangggggaaaattggggagnccccnccccagtggnaagccncccttcn

SEQ ID NO: 2054 - DNA, 640 bp, Homo sapiens
  misc_feature (1)...(640): n = A,T,C or G
nnnnnnntagacnttcccatggtggggcctggccctcatcttgaccaaagctgctgtgtggcagctcggcctctctacgaccccatcttggtggctgcacacttttcctggcccgcacccccatccccagtccctgttccccaagaggatacagagcacggtgctggctgactcaactgtgcgtcccaggttcagggtcttacagagctccaccccctggggtcttacctcactgggaatgtgttttgaaaatgaatttggagacaagccaacaaaccctgcactccaaaaaagcaaaacagaccctaatttttttgtgccaaaaactgtggacatgctggctcagcatcctcaggaccaagttgttgcttaatttattgntttttaataactaatccagataaaaaaagttgtggggcttcaagggtgacctgggcccaaaggttctgaagggcagttnctggcagccccagcttgcttgtgggaangggccgtgccgcacttttcatattccatggggnggtctgctgggccaactctgatgagaggcanggtggggacagtccatttgcaccctctgccttcaccaccacttatgtntgctgaatgggatcggnaccatggtatgnggactgggaac

SEQ ID NO: 2055 - DNA, 692 bp, Homo sapiens
  misc_feature (1)...(692): n = A,T,C or G
ttntcgattcgcacgagaattgatttgctacatgcttaaaatgatagaggttgctcagcatttttggagtacaagggggtcagagagacatgtgatgaaaattacagggcgagtacagagatttagaagggaacgggttttaatgcgagtatctttgacagagtcttgctctgttgcccatgctggagtgtagtggtgctcgctgcagcctcacattcaaaggctcaagcaatcctcccttggcctttgaagtagctgggaccacaggctcatgccaccatccctgggtcatttttaaattttttgtagagagggtctgactcttgcctatgctggcttcaaactcctgggctcaagcaatcctccttccttggcctctcctgaagtgctgggatacagttatgagccaccacacctgccaaagtgctttgtgatactatgcatttgttcaatgcagattgggaaacttaaaatttgaatggagattatgttgatgggctttggcaagttcatttggatagactgggatganaagctcttgggacttgtgactgggccaaaacattccagtattttaaaataaaaattaagcccttattactcccnttcatnaaaaagccaatccctatgggtanggaacatggganggtttgggnaataatggcaccggaaaaggnngccaccttttcttt

SEQ ID NO: 2056 - DNA, 679 bp, Homo sapiens
  misc_feature (1)...(679): n = A,T,C or G
tctnaanaattcggcacgagaantnatttgctacatgcttaaaatgatanaggttgctcagcatttttggagtacaagggggtcagagagacatgtgatgaaaattacagggcgagtacagagatttagaagggaacgggttttaatgcgagtatctttgacagagtcttgctctgttgcccatgctggagtgtagtggtgctcgctgcagcctcacattcaaaggctcaagcaatcctcccttggcctttgaagtagctgggaccacaggctcatgccaccatccctgggtcatttttaaattttttgtagagagggtctgactcttgcctatgctggcttcaaactcctgggctcaagcaatcctccttccttggcctctcctgaagtgctgggatacagttatgagccaccacacctgccaagtgctttgtgatactatgcatttgttcaatgcagatngggaaacttaaaattgaatggagattatgtgatgggcttttggcagttcattggataaactgggatgaaaaactctttgggacttgtgactgggncaaagcattncagtatattaaaataaaaattaagccatattactncactcataaaaagcaatcctatgggaaggacatggaaggttggggaataatncaccggaaaggnggcagcttttttt

SEQ ID NO: 2057 - DNA, 535 bp, Homo sapiens
  misc_feature (1)...(535): n = A,T,C or G
tcatcctgannctcnanagtcgaccngcangcntgcaagctttntnnncaaagaaggggngtgctggccggnnnggattcccccagccaaactgtctttgncagcacgtggggctcacttgtcatccttccccaantntcntagcccccgtnctaggttggacagcccccttcggctacaggaaggcaggaggggngagncccctactccctcttcactggggccacagcccccttgccctccgcctgggatctgantacatattgtggtgatggagatgcagtcacttattgtccaggtgaggcccaaganccctgtggncgccactgangtgggctggggctgctcccctaacctactttgtttcgcactnaccattcccctctanatggnacaatacaagantacctgccgtccaccctctgtctctgcccagttgtcattcttgtaaatacttgaagtggtgtttgtatgcatctcancgatgtgtgtcacncaatgtatctatgtctgctgcagncctccaaatttggga

SEQ ID NO: 2058 - DNA, 682 bp, Homo sapiens
  misc_feature (1)...(682): n = A,T,C or G
aaactgcannnaagatncttccagttcttggattnctaggtggagtaatattttcctgtncaaattatttccatgttatcctccatggtggtgttggcannaatggatccactatagcaggcnccagtgtcttgncacctggactccacataggactaatnattatactggcantaatgatctataaaaagtcagccactgatgtgttngaaaagcatccttgctttatatcctaatgattggatgtgtctttgctaaagtctcacaaaaattagtggtagctcacatgaccaaaagtgaactatatcttcaanacactgtctttttggggccacgtcttttgtttttagaccaggactttaataattttatagacgaatatgntgttctatggatggcantggtgatttcttcatttgatatggnganatactttaatgcttngagcctgcaaatttcaagacaccttctttaantatattcaaaactgcatgtcatcaancacctgaacaagntcaaagttcnttcttcaaagaagtcatcagaaataaccatgggantggaaganacntttccnaacacttgctatcntnttgctgctgctggtttcnntngaggggaaaattaaaccatttggttaaattttaatttaaggggtattncctattttcaacnaaataaa

SEQ ID NO: 2059 - DNA, 699 bp, Homo sapiens
  misc_feature (1)...(699): n = A,T,C or G
cntncncagcggnanagacntntccaataatgnnggatangcntntactaagnncacaagacttnanngnnatnnatngcngagnatcactcgcnctnanangattaccacgtgangagctatatcctcagcactctagtctgganaacctgcgaataaaaattaangatggnctacntnncttaacatttaacacctgtatggcccnaaaatnttnttgcttgctactatgcacataactaatgactatcttgcgcatntgatacctctggncacaanccaaanactgggtnntncngggaccngacntnanntnctagcnnngggcgttggacacnntanccttgtggaaacaataanaaaccattacntgncccatgnccctacnnacccatgatangccaaggaggngccaggtacntgagggtgactagctacntgaggtgggcnncatacnttacttnctcactgnagtngngtttgggtnaaattttaacccnnttacnccantggtagtcatncngtgatggncnatcacancagcaagnatganctcaagtagccctaaatgctcnangcaacctcttnttntgaggaaagaccttnactttntggnggnggnanaaactttacagnnntttttgggaacganttaatgtgggnctngcttttttgagaaggcccagncttncantacca

SEQ ID NO: 2060 - DNA, 701 bp, Homo sapiens
  misc_feature (1)...(701): n = A,T,C or G
ccagagtcnaggctgagaggatgcaggtgtcctcctaggaggtttgagtcagaaggcacgaggcagaagcagtgggggaggactccctcagtagagcgaggaggaggcccctcatccaagaggaggttggagcacaggggggtctaggtttgcagtttcgggaccggtagctgaggggtcccagggcctttcttctgtgaaggagaatgtgtccaccgtggggagggggtcgggagagagagatacttcagagtggacagggctgagaaagctttatgggccgcgaaaggcagagtanttgttggtggatgagggtgcttgtggcangtggcgtttcatgtgagacagctcggggcccanaaagacactgngaggaggagagctcctgctcttcaganaaacaggagcnnanaggaaaaacangaancgcnancgagccggcttgnggtcttggggatgaaacccaagntttacagcattctnttgnctttnncttggtgggaggtnggggggccattatttctcnccccctggtcttgggtccttttcccttgcccanccnaangggaaaaacaagaaccccttccccctttttncgcttcaaggantattccaaaaactgtccaaaatcttttnnngttggaannttaaaatttcnttaattcccctttgtanttttaaaaannanggtttcaagatnt

SEQ ID NO: 2061 - DNA, 738 bp, Homo sapiens
  misc_feature (1)...(738): n = A,T,C or G
agnttcgattccgcacgagatacatccaccttcangcaancgnaaactggncaaccagtatgagaaattccacagtccaagggaaagagaagagtatagtgactgaggngggtctctctgtccaacatgcaggcagcactccctcatcctgctcagtgagagaattcagggggaatagaaaagctgctgagagttggtaaagaggatggtcgagtgagatggtgttgacctccctggatcttatgtcactacatcctggacctcaagagggtcatccaagctttttgaaagctgaactccttgactggagaaacctagacaagaggcggggccaggtgcttgatatctaggaggcattcttcctcttcccttgccaccatggagctgggcacagtaagccatattgtttcctgaagcaggagtcccaggccttggctaganagggaacagatgtctnacaaaaagagaagcaattcgaggaattgatgaagcacaattaaaatcctctctggctagtagctctctggctttctgttcatttgaagaataaatctttggcttgacagtgggaagcaccaggtttgaaatcagatggctttatttttcttttttttggcatttaaatcagtgaaataaaattattactggaganccacagttcgatttaaagagattcctcaccctgtttttcaaagtccttcttttnaaattccatgcnttggggggttaannggnaaa

SEQ ID NO: 2062 - DNA, 743 bp, Homo sapiens
  misc_feature (1)...(743): n = A,T,C or G
antttcaattccgcacgaggaanatatatncntgaaggcctgtggcctaggaaaagganacactgaggtgnttcctacccaacatgtggnccgtgctctccaaactatctttgagctgaacgtccaggcctttgcaggaggggccatgggggctgtgaatgggatgcagccccatggtgtccctgataaatccagtgtgcagtctgatgaagtctgggtgggtgtggtctacgggctggcagctaccatgatccaagagggcctgacttgggagggcttccagacagctgaaggctgctaccgtaccgtgtgggagcgcctgggtctggccttccagaccccagaggcatactgccagcagcgagtgttccgctcactggcctacatgcggccactgagcatatgggccatgcagctagccctgcaacagcagcagcacaaaaaggcctcctggccaaaagtcaaacagggcacaggactaaggacagggcctatgtttggaccaaaggaagccatggcaaacctgagcccanaantgagccgtctgaactgtgggaagggaagtgctaacagcccaacctccaacctggncttttcctccttcccctttgaacctcctgcaaccctgaacccntcaggacaattcatacccccttcctttttttccacccaatttgttgccaattaaattggggggttgagggntgaccntaggcagcattaagaatcacttattttatttn

SEQ ID NO: 2063 - DNA, 672 bp, Homo sapiens
  misc_feature (1)...(672): n = A,T,C or G
gaanccactgctgcgcaccctggagatgggtnggggaccctgggctcccgttaatgttgttgtggctccagatgcctnagaaataacttccagagtcaacaccatctgcggaagtgccgtgagacggtgcatgggctggagacagagacagccggcgccgaacatacctggggctgcccgtgcaaactggggcaagcccttcagcctccatgtggctgctttactatggagaacagaaatgactagaacctgacttgtggggttatggcgagggtggcatgagatgagctttgtaacaatgtgtttgtttatgggcagcaaaaccctgactcattgtctgggttactaatatccaagagttcatcatcagcgataattattgtcaatagtcgtaactgcaaaagtctcttttaaagctaaaatggatgccgggccagtggctgtaatcccaacactttgcgaaggccgaggcgggtnggatcacttgaggtnaggaattnnagaccggcctgggtnacaatggcaaaccccgtntctactaaaagtgcaaaaattaacccagggtgtggngggcaagtgccttgttaatcccactacttcaggaaggctgaggcaagaaaaatnactttaaacccnaggaaggcggaatttttccattgagnccaanaatcg

SEQ ID NO: 2064 - DNA, 746 bp, Homo sapiens
  misc_feature (1)...(746): n = A,T,C or G
acctncgcttcaanaancttattctccttctcagcngcgncgtctgnacgctnattcctnnatcantattnngtagacggnccacccctttannnacntcgnanncatccatcacgcttcagcnnncgnngctntgncggagnatngncttntgtnnngcgnttcgnnangttcctgcaaaaagaacaagtagattgccanaagaactaangttaaagaacattncttcnanacactattaatgggcttaataagcanaggcaactgtttttgtcanaaaacanaaggaaagaacttntccanaggataattgtggagcttgttgaatttatatctcccaaaacccctaaacctggagaacttgggggaagaatatctgggtcagtggcttgganagtacccgaggtgaaatgggtctacanagaaaagaaaccttgtttattccctgtgaaaatgagaagatttttaaacagcttcccctttgttacaatattgtgaaagatcgttattgttcnagtttcaaatacaatcaaaccatttcttggatggggagaatggcntgtggaaaatggaatctntatttcanaaaaagttgnaacagactggcacatggtattttttggccccnaaanggaanggatcatntttttcttatttttccttggaagtttgantnttgggtcaanttggccttaaaagtaantaccnttttctatttaaaacaagtnttcaaaactttttaaacn

SEQ ID NO: 2065 - DNA, 1005 bp, Homo sapiens
  misc_feature (1)...(1005): n = A,T,C or G
ttnnnnncnnnnncnattncccannnnnnntnnnnnnntnnnnnannnnnnnnnnnttantnnnnnnnnntntnnnnannanntnnnntnttntnnttnatgtntncnnnnnnnnnntntgcgncgtntnnnnannncnntgttananantnncnnnntnnnncnnnnnnnnnttcgcccnccntnccatnnnnncccccntacnncnnnttnnnntnnttnngantntacagtnggaaacaatattnttttnnncnntggnggcctcccttcatttacctgggtgttttggctcaccaaagagttgtgttctgcaaatgtctgggcaatccntggagctaaactggcattagagtcaagtaacactcctcctctctccctgttcttttccttaaaatcttcaaaggcattgggggttttaccttagcaacttgctatttcgtcttcttagtttgaaccttcaaatatagctggatataataaaatgctcctcaaatgaggaagtaccanaaagaccagatgcatggtctcatgcttcccttgtgctggggcacaagatctaaacaaaaacaatgttgtgtccatattaaagagcttcataaatacanatgggagtgaatgaatgatttatgacangtgttaggttgtggaagcttggtagtaatacacagaattctcagaatcatgcctgtcccgtggaataaaaangaaaacaaccttttctttgtaagggttagaagatttgatggggaaaatccangaaaccatctaaggangctaaaagaaaagaaanttccttattaccccagaatngttnggatngtatttttgccaacattccttctcanttgcctggacaacgataangatttctattttggaagaatnaatgtggtnttaaaatcaagaaattcttgaattttttcnttggcanggcatngaggacaanagtngaaaaaaaaaatnaattgggaagaanaatccntatntggtaantttttcnca

SEQ ID NO: 2066 - DNA, 1022 bp, Homo sapiens
  misc_feature (1)...(1022): n = A,T,C or G
cnctcctttncctnnnnnantntcntantcnnnantnnttnnaaantancnntncnnatatntannnntctagnnnntntttctttcnctcatannanntntntntntntctntgtanttnattntncccccccntnactnaccccccctctnntctnnnnnnnnnnntgancntcagtcngacacganattctgngccccctnnncccctgnncnnngtacaatacncatggntctgttcnccanntntccccctgnagtggatgctnncctgcntnngggaggntttctcctaacttncattcctnnacttcccgnaagcagccccnaacacttacttatanagccatctctatctgaattagnanatcatggatnnnctcantanctgancatttccttatcagntaccaccaatatantattttaacactgtctccttttcacacacnctagcttnctaanancnagctggggggctggcntgntgatccacgcctgtaatacnancantctgtgtaggnagncgtgncggatcacttnangtcanggantttganacacagcctgnctaacatggttgaaaaccccttctcttctgaanatgctaaaatatactggntggtgtnnggcatgctctgttgatccnanctacctcactgtaggctcgnngcnnnagaanncccttnanncccatnnggannnntatgnntgctattcgngnccatggnntcaacaccnaacttngacttcctannttntnnggggntgtatnaaanctganaatactcttcctncaanatataananantaananntngtccaataatcccnctntacngtgacttcntntacnctctctccncacntatcattacatctgcctncnccccanctnntnaantatatgaanaatacaccanttntgtntctanattctnattcggccccttncnttggntncacntatttantttcnatttntnacnccatattcnttnatcgtntctanctcnttccc

SEQ ID NO: 2067 - DNA, 991 bp, Homo sapiens
  misc_feature (1)...(991): n = A,T,C or G
tnnnnnnntnntnnnnnnttnnnnnnntnnntncnntnntnnnnnnnnntnnannnnanntnnnnnnnnnnnnnnntctntncnntnnnntnggnntatnnnnnnnntntntntntnntnntnttnnttnnnnntcccnccnccnnnnnntncccctcccnnncnnntntnnntnnnnntnagttnacagtaggangnggaggctcttcttnacgtgtngggacnnncatcctggggcattntcaactgcgtnttcattgtgtactntctgatggagatgctgctcaaggtcttnggcctggtcctgcgagggtacctgtcctaccccagcaacgtgtttgacgggctcctcaccgttgtcctgctggttttggagatctcaactctggctgtgtaccgattgccacacccaggctggaggccggagatggtgggcctgctgtcgctgtgggacatgacccgcatgctgaacatgctcatcgtgttccgcttcctgcgtatcatccccagcatgaagccgatggccgtggtggccaatacccgtcctgggcctgggtgcanaacatgcgttgctttttggccgggatcctggtggtnggtctactacgtatttgccatcatttgggatcaactttgttttagaggcgtnattgtggctcttcctggaaacaagcatcctggcccctgccaatggctnggcgcccctgtggganctttncagcagctggantacttggggcccaaacaacttctaatgaactttgccgggcttgccccttggtccacttcttgtgggaaactttgattgggnngggtngnaaccaacttggccaaggtgtttttcttgggaatgcattnttngggcgcttncttcnaaggccccngnggtcccaagaancttaatttttgtnanttgnggggggggnnntggtggttcttatttgncattnttnggggncaaccntgtttttttgggccncttnaattttnn

SEQ ID NO: 2068 - DNA, 1054 bp, Homo sapiens
  misc_feature (1)...(1054): n = A,T,C or G
ttnnctntnnttctntttnntttngtntcntctctntntcgtttgtntntnttnnnnttggttgtngtttcttttctgttcnntnttttncccctccccttnncccccctcncttctttntnttttngttncagtgganggtttttnttncctnngggcccgggnntngnnntttttttttctnctcntttnattcctttttngtggtgttganncttggggaaannggggggntttttncatgctcntcnnccacttttcntttacnnggcttgcttcctttgtnngtttttctttttcntcttttctatctttnttgnttttttcntnnnntntttttntggcngttttnctcctcccncctntngctttttncntctgngtctttnttggntcntctctcattntttgtgnactcntnctgncntngtttcntntactcttntcctgtntnngctatcttctntnacttctattnnctttntttctctgttctnttcntttcttttgttctgttncgttcntcttttntcnttttnctctcttctcntttncttnctntccttcntgtcctcctcttntctcttttcnntctnnntcctncgtttcncgttttttttttgtcnctcttnngnttcttcnncgttcttgcttcttcntntnttttttccctctttcctcttncgnnntncngtctcntttatcaagtctactntnntttgntctcttttctnttcnttgnctgctttctnnncctgcttttcctctnnttnnctttctttntacnctttttcgttanccttnctntnctntttcnttgcttttctttnnntnccctctttnngntcttcgatttttccntntntttnncgttccattnntnntccttttatttcnttntcttttatttctggtntctntncntttctctntgtanctnttcttttacttcnntttnttggtnnncctnctttttctncnncgatcgcttnttgttctngctcttcntctcnttcnttntnntgntannttntactnntttctcttcttcncg

SEQ ID NO: 2069 - DNA, 711 bp, Homo sapiens
  misc_feature (1)...(711): n = A,T,C or G
aggtntcgaatcgcacgacttgtccctgtggggtcttacagatgtgtctctgagtagtaaaggcttagccttgttctgttttgttgttttttggaggggaaggttagtcaggcctgagtattcatgtaacattctaaaattgtgccagcgagcaccgtgaacgactgcaatgcaagcgggtcttgctggctaaaatgccaggtaaagggttggttggacacagcgcttagtgcacgctgtcatcatggacatcataatcagttgtgaaaaacacgcgaacctatgacacttcttattccacactgaatgtgaaattgcatgttcagatgtttactacgaggcctggctcacaggaagtgttcagtaaaagtatgcactgttagattactgataacgcggatagatttttgtttaccataaattgttccagatttatattaatggaaggaagtgtgcatttattaactattactcaactttacaatgcaaacatcttatttctcatctttaaacatgtcgacaagtttaattgaaaagtattctgagactgcaaaatggggtgttaaaaaatactgcagttacngactgtgtaaaccagttctcattgcataagatcagatgtaaatgcatggagaggtgatatgcactgtacagnattcactccccatttcacatnttgcaganaatagtcttgtcatactgagtgtctaa

SEQ ID NO: 2070 - DNA, 825 bp, Homo sapiens
  misc_feature (1)...(825): n = A,T,C or G
atncttttcgaattcggcacgaggttgttgttaccgtgtgcccccnngncccatgnnggnngtgcnntgtngacacacagnnanncaannanntgtgncagtctgtattctggagcnttgctncttgncanttgatttgtactntanttagnagaagcctgtacactgtagcgtggccagatgtggagttcagaggcatgctcacctggctgncttttnantacttaccttatagccattnttanactgagagcttnaactgaacatataatcaaatttngtgntaaggaagtgagattttancagtatttttcagttttgaagttcgaaaccatcccaaggcataggagccatagcctcaactgaaattgaatttttgtagggactgttaattgccatttgtacctaatactgnatatatacatatatataccgtgtgtatatatatatanatatatatatatatntatatntntatananatatatanacatatatatatatatatntatntantacatanttngtctntntcantgantntacaagagannnntnnttcantagaacantcttcaatcnacactcnnctgtccncncgctncgctcaataannctcctaacnatcacttcancccctttncntctcncctngnatagacnnanaaatcttactcancttcttnttatcatagtcntnttnnatantanaanacctctnttntancnnatcatcnttncntncntgcttngnntanaacgnnagaaatatctnnacatcttntcttatctccaattcttcnnnntncttacanccnngcgnct

SEQ ID NO: 2071 - DNA, 729 bp, Homo sapiens
  misc_feature (1)...(729): n = A,T,C or G
ccncgancccnatnnnanaaataanattgaagatncttccnnttctnggattnctaggnggantannanttacctgtccaaantatnnccatgnnnanccncnntagggcangggnaagaatcatggctcatgantngtgngggacaagtggtcgcagagcacaggctctnggtaaggagacctggtttgagtttataaccagagacaggcagttcaccaactgagtctcaaatccttatctggaaaatgggaataatttgtcttctctggccgagctgctgggaagctcanagatattactgcataagaangtgctttatacctgtgangcgagatgggaaatgaaggatgattgtcttgatgatgattttgngctggagctggcttacaatcccctgacagtgacacctgtaccatanaagtgagagaacccagcgacnccaagtgagactgggaaggataggccctgggtttgaatncccnctgtnctcgttgtgggcccccttgacttttttgacaancctcatcacattccttaaccctcaanttttgccctgtctgntaaaaaagggtncacaantgntgcctttgtgccccanttaaacccaaggaactggggaaaatgcnttggccttgaggggacaatgantaaccncaatnggngggccttgtnaangaattnggccntgggacccttnagggggntcccctantaagggggccaaant

SEQ ID NO: 2072 - DNA, 749 bp, Homo sapiens
  misc_feature (1)...(749): n = A,T,C or G
acnttnacgagtnngnccgaggtcnnnatcaatgtcnannncntcaacaggggnatanctgaccntaanantncnnnaacgtctgnncatnnctgttgaatggcnctgctnatnatagtantgtntgccgaggaaaactnngaatntgacgaggcttataaaaccatggtagccaggcgtggtacgtagctcacacctgtaatcctcccaaagtgctgggattataggcgagagccaccacgctcagtgagtatgacatttttaaaagaacagtataaagcataaaatatcccatgtggggcaaactcccagattattttcctaaacaaatagaaaaaatgcttcctgaaatagggtaagagaggatgagtcatcaggatccctgaaacaaagatctcaaacaggagaccttacgtatattattcatcaatatcttcagtgcaaaaatgcaaagccatttacagaaagggcacatagtaagctttacatactttncttaggaacagncttaaaacttaaaaatctcatggtttaataaagagtaataattttatggggaagcaattttaagatttaaaatttcagagtatcttccataccagcagtnttatttaaagtagtggaaaaaataagacaatttaatattcccatggatggatngattaaaaattgggtntggtcanggnggaaaataaaccntgccccccaatttaagacttcctggccaaaantttgggggaaaaaggtnt

SEQ ID NO: 2073 - DNA, 1498 bp, Homo sapiens
  misc_feature (1)...(1498): n = A,T,C or G
tnnnntctnnanncntnncnnnncnnnnnnnnnnnnncannnnncnnnncnacnnntnnannnncttncncnnnnnntntnnnncnnnnnnnnncnncgctnntctntnnnnnnntnggtnnnngnnangtcncngntancccncannnnnnannnatnnntatnnnnnntntnnnntncgcncccccccgcccccntannnntncccccnnncncnttnannntnnnnnnnnnnnnnnnnnnnnanncngntttaccaanattcccnccncggggggggtcctataaatgcctatcnacnaggnncnnccncctnnatnnccccnatttctagcngnccccttnaanannnncccagcnnttntnttatgctggangangggantgcnacgttgnccctncnggggggggttttntagtcnanaaagggcccgacggccanangccngtgggggagggactncactcagnataancgaggaggaggccccttnatcnaagaggaggntggcnccccaccggtgcnncnnaggttcnnccttcttacgcncctggntactnnagntnttctttgntcntaacttatttgcntcatnannnntctntctccnnctnnttannnngnttcnntcngctancatntttancatctctnnttnctactanantntctccntnttcnactangaacttccgatcannggntntanncnntctcntcnntgactaacntcatctgnnatcttaanntcntnntttnntgntttcnactcnttttttgnnntctcactgtcatnncactctananagntcncttnctnnntatctnannntcnnnttcacnncttctntnntccttntnatcgcnnntcatctacgacctctatgcnatcanatgcgcgngnatcatatgtgccnttctnacaagtntanntcntcgnntaattacnctcncatantatctcacnnctttcntttcannactantatgntnggtgaggctatatagnacttngtgganggggtcntctcttntacntttnatcgtgnggnacgntttncttnnctatnatctntancaantttncttanatnctggggtcnaacnnnananncnaancntcncgcncncnaanatacnctgctatnnncatgcttnanacatatntatnaactcntcatcttntancgcttcatntgnatctctcntctgtttctntnatacatcanaatccatnnctgcnacnctcntntacnnctcctatnatatgcnnttcttcacanttntacctaccgttcaccatntatnnaactatanntcacatnttanatgnncnnntacnnncctcnntgancaatnctgttttcttnctctctctcatctntntatgngtnttacntcttannatctntctncacgcntntatcntangcgtctntncaaaaatntacgnntctnncncatcctcacnctctnganccgatctannnctgncca

SEQ ID NO: 2074 - DNA, 947 bp, Homo sapiens
  misc_feature (1)...(947): n = A,T,C or G
ncntcaattccgacgagggtacttaataagnngacaanccagaaacaatattgaagatctgaaaaatctagccgaccanctctaggnnggccctntntcnnanagtgggngatgggcattgntttaactattaccttaggtccgtgataatatcccntggcccagcagaaattatatacttggcaacacatatttttcaccaggaagcttcacccagacactgancanaatggtctnttgcaccaataaaggctcacntaaanggntngtggtnncccaagnaaatanacatttctnaattgcnaaantggtaaactgctttancnccatacaaggngnctatctngaaacgnntttttctnnnanngcntcatnngtntcntcttctatngccnnattaactnattgantnnttnnnatgncatncnnaanngcgntnnacatctcctncttatatcnaatnccnntnatctcnnnatnctacntccnncnatcntttnttcattcanntttattaccttgntcnccanctgctanccgtcttcnganatcnanccttnnnnttntncaannctantttntntcaaaatgggccnnctnttttanatnncnactactgngatatatnntntcnnntgacngtttnatncccctaacnacnatatcnnactnttctctccnannaannaannngnncatttatnttnacgggaaaaaaaatctcannctccngcgnccctngattgggctttcnacccccttggnaaatcncccancnacctnttgggnaaaggccnaagggtnggcccaaaaatnnnccttgaagggtntnaaggaanttttctaaaaaccaagccttganccnnntnttggngaaaaacccccggtttttttcttnaaaattcccaaaanttcnncnccagcnctnnaatcnngcccccctctgn

SEQ ID NO: 2075 - DNA, 689 bp, Homo sapiens
  misc_feature (1)...(689): n = A,T,C or G
aanttcaatccgcacgagggatcttcttcaatcagcaataacaggtggctctatagaatggagggtagaagggatgtgggtgacttactcagtttttagttaaagaggaccctcttctgttagcatggtgaagtgcagtttctttaataaattgtgcatggtgggggtgggatttggattctgtgatacaatcttgtttctttaggaatcttttacttttggccacttgcctttctttccaaggaatcccactccctttcaaggtgcctcatgaactgttttcatgaactttccaaacattggtttctgcttgtttctaagcctgattcttggccttctcattaattttcaaaacttccaatatccttccaaataattcccttttgcttacgttagcgagtactagtttgttagccagtggtaagttctggtgatcctaaccaaaaaaccctaactgagatatcagctcttaacgcaaaagttgngaatcggcatcctcatatgaagangggagtgggaattgggtgtgggacttncgggatatccaacagtggatgctaaagnccttacataaaatgcatanattggtatatcctcccatcatcatctctagatattatagacttatacaatgaatgctgggagcatcnggattttactggattttgnggttgnggaattaaaanatt

SEQ ID NO: 2076 - DNA, 888 bp, Homo sapiens
  misc_feature (1)...(888): n = A,T,C or G
ncttcnttcctcgaggacactgnctnctgaaggccgntggcactaggcncancagacantcnctgcaggtgcaccaactacagactcacactaatggacaaggagntttncncaatncagtcccacgcctttncaggtaggggccangggggctgtgaatgggatgcagccccatggngtccctgataaatccagtgtgcagtcttgatnctccaggtggncagncagattatagtgcagcctgngctgagtattatagacancaancatnctattgntgtccagacaagtncccaggggaatgccacanctttcttnagcacctnatngtctanttttnanaacncggaccgttancagtttttgcttcatttntttgnngngaannnacanacntttttnttaaacnatntnagattnctnnncganctttcnttaacgcatccttctntnngntntttcggtntataaaancgnttgnctattttttttttnntctncgacaatggtccnnnanntnttttttntctttnttngagnggatnggntnanatntcttcttgtnnancaaaatnnnantntttngtcnttgtttttttnacctnannntgcanntggaantttnactannncttcnntcnnattncttnacaccattgggcccttttccctactntttaccacntcgtanaacantnctctngtanctacttangtanctncttagngtgnnaatatntntntncaccctntttctacagctctgtattcatcttcctcagtattntccttactctttacatntatnnnngtttantacgtntcgnntcttatngnnnntaccctcctactatttgtnacttatncacactnttctcntcatnaccc

SEQ ID NO: 2077 - DNA, 721 bp, Homo sapiens
  misc_feature (1)...(721): n = A,T,C or G
anttcgantcgcacgaggtgcctcctgcctctccaatcctgatcccccattcccagccaaggagaggttttcagcccttggtcaccctgatgacctgcagctttccaggccctaggctgagaagtttaagtccagtgtctcattaatcctcataataatctagggaggccgggcacggtggctcacacctgtaatcccagcactttgggaggctgaggcaggtggatcacttgagttagaagtttgagaccagcctggccaacatggtgaagccccgtctttactaaaaatacaaaaattagctgggcgtggtggcggatgcctgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatttttaaaaaaaaaangaangaaaaaaaaacccccttcttttaaanaaaanacctaacaaattttaatatagttatctctaccnctttctttttaagtttcttgattttaactcangctgnattntaactcatctgggaaaacaangngttttgattaaaaaaatatnaan

SEQ ID NO: 2078 - DNA, 733 bp, Homo sapiens
  misc_feature (1)...(733): n = A,T,C or G
acnttcaatcgnacgaggnctntnnnctnatagccgcgggncccagaattcccaagcgtnggattgntcacccactaatngggaacgagagccgaacagntgangagagttcactgactccccagccccaggtgggccttgtgcacatcatgaccagttttgaagatgctgacacagaagagacagtaacttgtctccagatgacggtttaccatcctggccagttgcagtgtggaatatttcagtcaataagttttaacagagagaaactcccttccagcgaagtggtgaaatttggccgaaattccaacatctgtcattatacttttcaggacaaacaggtttcccgagttcagttttctctgcagctgtttaaaaaattcaacagctcagttctctctttgaaataaaaaatatgagtnaaaaagaccaatctgatcgtggacagcagaaagctgggctacctaaataaaatggacctgccatacangtgcatggtcagattcngagaagtattcaatttcttgatggagaaaggaanatggcgagtcattggaattttttgagactcaatttattttatcttccaaancactctttgcagaaaacaactgggcccacacangnccataccggagtattgnacttattcgctctgntcctnccaaagcagtnttccgacagaaatggntgaaaatgagtcatgaacccccgaaaggctaaaaggagaaat

SEQ ID NO: 2079 - DNA, 808 bp, Homo sapiens
  misc_feature (1)...(808): n = A,T,C or G
acnncgctttactagcttattatcattcgcanccctgctctctnacccccagcgtccacagagctggatgttcctcacaatgtccaagtggctgcagtggttggcattggccttgtatatcaagggacagctcacagacatactgcagaagtcctgttggctgagataggacggcctcctggtcctgaaatggaatactgcactgacagagagtcatactccttagctgctggcttggccctgggcatggtctgcttggggcatggcagcaatttgataggtatgtctgatctcaatgtgcctgagcagctctatcagtacatggttggaggacataggcgctttcaaacaggaatgcatagggagaaacataaatcaccaagttatcaaatcaaagaaggagataccataaatgtggatgtgacttgtccaggtgctactctagctttggctatgatctacttaaaaaccaataacagtgtcttctangaagcccagacacatggagaaattcttgagtgtttttggncgataagtcccaanatgaaggttccagccaacaagcttggggatcancccattaaaatgttgaantgaaggaaagcttttgaaaatnggtttcaaaccccttaacccccccacctgganccttcattaaggaagaccccccaaggaaatggaagaaaatcancctggggncccaaancccttaaccaaaaancctttcaanaaaatttccngaaaaattaaaaaattaatttccaattctttaattttttnaaaaaaaaaaaaaaaaannnnnnnnccc

SEQ ID NO: 2080 - DNA, 1361 bp, Homo sapiens
  misc_feature (1)...(1361): n = A,T,C or G
tntntnnctcnnctttttncnnnccntcnnntcnntnntcnttctntnnnnncncntntctntncnnncnnnntntcncntcnnntncttcccttcttnttnctctnnctnctcnntctntctncctnncntnntntntnccccccnctcnctnntcctccccccctctcnnntnnntnntnnttnnnccnncnangtnggaanccnnntttttctnttancttttctcnccncccttttgtctncttcntatnccttntccaccncnnnnttttttttgttggcctngatnnctcccnncncttgnggtncacttttnttntnncccttcnccnccttancttnccccctctcntctntcnttcttgcctncttctctntcctctctcacccnccgttcnncttctcttttacttntcnntncccctctccccttcnttctnccccntctctcttttccgacntcntntcctccncnttctctttgctncctncacttntcntctcncattcttctctctctccntncccttccggncttttncttnnttcgnnntncctccttcnntntctccnttttnntcnnntacntcccctctcccnttactcccnttcctctctctctcctcctnctccccnnncctctnncctcttcctnttctcttcnnctctcccntttnttctnntgcntctctcncctcctntcctccttnnctnacctcntnctnctntcctcntcttcttcttctncgacctcacctncntccctctncntctctntcctctcttctctccntcnntctctcnnttctcttttcttctnnccncnctttgcncnctctccttttggnntnctttccnattctnttttntcntcccctctnctcctttntttttctccnctctcttctctctttcccatnntttttncnnnctnttcccnnttctttcttatcntntntccnccttcnctntctcttctctcttccanncntntctctcntttncnctccctacncttntccctctcccnctcnttcntctcttnctccctctctctacccacttctnttctccttacnntctgctcnacnnttntntctnnctctgtacctatctantttcnccttcanttactccccctnttctcctntttctctntnctctnttctctnnctcctnttncttcnttcctcntttctcctctacntctnctcncntcnatctnctcccntctctgtctcccttccctttttctcntctattnctccttcttcnttnctccctctgctcctctcntnattntctgtcntctctctcctcttcttctctttctcgtcacnccgcttcancnctttcct

SEQ ID NO: 2081 - DNA, 740 bp, Homo sapiens
  misc_feature (1)...(740): n = A,T,C or G
ctgcactgcaagggaggtgagtgagaccaaggaactacacccaccaagatcccttccaagggtctaagttgcttctntaatcanaaacctctcaaacctttgcgactgtgcacataggtcccatgatggctttggcaacatttacctgggaccagggtgaacttcgtaccatgtattgcatatgagaaaagaaaagaatgtttgtcaaacaaaccactatgttttattttattttattttagtgttgctggtaggtgtgtagtgagttctcagtgtgtgtgtgtgtgtgtgtgtgtgtgngcagtttttttttttttttggganggggttnnncttttncccccnggnnggngggnannnacccnattttggntacccanancctgtnnnnccgggttaaangannttctnctgnctaaaccnncccaaannnnntnaaattncnggggtgttccntncccnccnanttaattttttgnctttttttnnnaaaancnaganttnncncctnttngnnggncccngggntggnanaaaaaaatnttccngggccnaaaaaggnaanccccccnnccnttaanccccatnnaaggnngngnggnanttnnaggggngnggaccccctnggctctcggttttaanggggggntnaaaaannggttttnccttaaaggnnccttgnnaatnccnanaaaaatttttcnnncngggaanngcttttctggnccccttttngggan

SEQ ID NO: 2082 - DNA, 727 bp, Homo sapiens
  misc_feature (1)...(727): n = A,T,C or G
aagttcaatccgcacgaggttcatncataatgtagcnngnntcagaagttcatttctttttatggctgaacaagattccattgtgtgattagattgcattttctttatccgtctgttgatggacgtttggggttgttccactttttggccattgtgaagaatgattctttgaacattgatgtaaaagatttcatgtggatatgtattttcatttctgttggctgtataccttgcagtagaattgctgggttgtacctttaactttctgagtaactgctcaaacacagtaaacacacagttttccagttttgcagcactattttatgttcttaccagcaacctgtaagagtttccactttctccacatcctcgccaacaattgtcattgtctatctttttcattatagtcaccatagtggctgtaaagtggtatctcattgtggtattgatttgctttaccttgatgaagtaatggtattgaacatctttttcatgtgcttattagccctttaaataccttgcttggagaaatgtctattcaaataaatctttttgcccattttctaaaggagttaattgcctatttattggtgagttttaaaaaggctttagatgtgctacataccanactcttaccagaagtganttaattgcaaatattttctcccattctatngggttttcttttcactttcttggatagnggcacttggaganataaaatggn

SEQ ID NO: 2083 - DNA, 727 bp, Homo sapiens
  misc_feature (1)...(727): n = A,T,C or G
aagcctntcgaatcgcacgaggttgttgttaccgtgtgccaangtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgcttacttggggttgataagatttgagtgtttgcaattttttactaaatgtagctccaaagtcttaaatggcttggttgttcttaaactggtaattgatgaaactgtgcataagtttacaatgtactaacttattttgcttattatatataggggtttattgggaaattgtaccncacacttcagcatgatgaaaataaaaaataagtggttccatttaaataaatggtttat

SEQ ID NO: 2084 - DNA, 1126 bp, Homo sapiens
  misc_feature (1)...(1126): n = A,T,C or G
nntnntnnnntanntcnnnntcttannntgnntnantcnnnntnnnnnantnantnnnntnttnntttnnnnnnncnnnntananctnnnnantnnnangangnnnnnnnnnannnnnnganntatnnnatannctnataannntctacnnattnnnncncnaannncgccncnccnannannnntanncccccanncnntnntctncnnctnnnnnanagntntananatacccngggggggttcnatattcatnaaccaggnnncnngnnaaatacatanttccagactgatacttggtggggnngcccacccttctaccttggggtgcctcatggcctaccccaggcttttttntccactgggtcccactgttncctgganacaagangggctagcatgctgtcatttatctgaanggntgtggctgacccattctcctgggatttcccaggccacctcctccctttccctttccctcnacttaacccaaactttgcntcagctggatgctattgtccctggatgttggcctttacttggtncganggttaattggctgnntcttgccttgccataggaaantnttggctgnnnattttggcaanatgtgnggaagaaacnngtntnaangaaaangggaaccnaggagtanttggatcaaanaatnaanngngggngaatggggggacaagaagganaatatgggggaacnttnntccccntttggnancttcttggcccttttggggccccctttnggaanattgtggnnncncgggtaaaaataannnntttanacngntnggnnancccctttgtnaaaaaanatannganaaaantggnanaattnttttaaaaaaanccctgnttttccanananaaaaaacacattttttttcctttgggtaaaaannaancnttgtttannaaaancntanntttcnnntnnaaatncatntnttattaaaaaaanaaacggnttntattttttaaaccctcccctgntacnnctaacaaaannttttcntcttgnncccanaaaananaaaaaaaannttactccagtnntattgccncntntcaccntgatgnnggcnctttcttgngctttttaataaaana

SEQ ID NO: 2085 - DNA, 721 bp, Homo sapiens
  misc_feature (1)...(721): n = A,T,C or G
angttcgattcngccgagggtaattaataagcagacaaatcagaaacaatatagaagatctgaaaaatagagttgaccagctctaatgggtccctgtatccaatagttagagatgggcattgtttttaggcacatgtgaaataatggcccccccgttctggcccagcagaaattatatacttggcaacaagtctcatcacattttaaataaactgtcaaaaagataacattctcatgtttccgcaatttaattttaaaatgaaattaaatttttttgaaggtaaaatacattttggaaatctaaactgtttaactcttagaacgaacagtggaaaagagaaaatataactgaatgataaggaaaatatatacacatcagattgatgtgatgcagccaagtggcatgtagaagaaactctagtattagtataggtttttcctatactttccatgtagtatgaacattttatataagtattttaaatgcttatttaaaaaaggaaattacagagttaaccaaaacaaggatttgtagagaaaaggcatatgtaaggaaagaagtagtctgggcgtggtggctcacgcctgtaatcccacaccttgggangcagangtgggccagatccctgangncangagttcgagaacagnctgaccaacatgganaaccccgctnttctaaaaatacnaaaattactgggcgtggtgatgcncccctgta

SEQ ID NO: 2086 - DNA, 1036 bp, Homo sapiens
  misc_feature (1)...(1036): n = A,T,C or G
cnaccncccttannnnnnntncngnntancntngcnanggttttnntnngnaatnnanctaccntnctttacgncgntncnntannnnttnancccnannntntnngctgnnnnaanncnggngncannanncnnactnttangngnnncnnttntctnnntngtacgctntctnatanatgtncgtnnnannnctnnnnnngccnccccncctccgnnnntancnncccccncntnnnnnnnnnnnnnnnnntangangatcgnattccgcacggnggggtntcttcttcaatcagcccccccnggggtngggctctatngnaatggaaggngttcaacgcatnttttttgnctgncnctttttccnacantacggggggnnttttnntnanncaccccctnttgtacncatanngtgngaattcngntnganancnctttcannnntannnnccttgttntnacnccnctnntnntntttcnnngctcanatntanntcngtnnnttcntnccantctnaacngtnntcnnccacantttgnattntnnnctacaacatncnnttatnttnnccnctntntcncacnttttcnattcanccacannnctntctannnncnctcaccnttcctnccnnttcntncgntactcnntncnctcntcnncnannnctcacttgnncgtgngnatactcanntaantctanntcntnnttctgnnnnantcattctnncanacgttccagannangtctatnccntacnatatattnacatnannancncnntccaccntngtnnatgactacntcnnnacgntnataactactcacntntnngnaanactannttactgnngcgnatctaactcaccttcctccaacataacnntatcnaanngtntanngtatgcactantctatctctatngcncanaanatnnctntatncgtaantncacancnanctattntacgctnctnacnnanncattcgtanatctacatatncttactatcacaatcgacntagncc

SEQ ID NO: 2087 - DNA, 1694 bp, Homo sapiens
  misc_feature (1)...(1694): n = A,T,C or G
cnnccccnnanntnncccnnnnnnnttnnaanccnncnnaccnncccnntnngnnnncctnncccccccacnnccttcntnctantnnccncnctnctnccccntncnnnccnncctaccnngnaaanncttnanantncnntacctttnttcnncannctggngtctttcnnntccaannctntttnccnnnncnnaccnactcncntacnctctcnnntntnntncngcnccccccccnncncnnnnananntccccccncncncccttanncanntcatntnnnnntnanngccntnccnaatccgcacgggaggtttcntactgcctctnnnacccccggngtcaacattntnnatccacctnccccnctataccacntcancntttttntaggcnctagtctnannanctncnctacatctngggggggcttttttttntnatntntantctccccccacntctcaccccccccctncatcaaccantcatannccnctctaccntntcctttttctccnctcnncnangctatnactcctncacnnnanttcntcnganagacnannccctacatatcatctacntactatntctnctactactgnaactccttcctanacgatcnttcnctnnncncatnatnnancntctatctntacntncnctaantntnctntctcgnncacnctctacaaantcatntcaancactcnnancccacttactatcgcantatatacctagtntgcnancatcntncactntcnatnntntcctacatnnctctcatctcnctntnatcctcacntcncgntcctcncntntnnnactcctcatnactctnactatcgctcatnctanactnacnctcgnntttcnctntatccacgttctatntcncttnactacnatctncttntctnannaactnaatttntntnacatctctntacnnatcccntnnnnacncntntttaccttcggtcnatctcctttcctcttctctcttacgtatctctncctancacttnaccttgcattcnccnngtcatcntnctacctcactctcanntnnatntcannctaagctaccncttatancctncannnatnctccnaaactnctcacatccnnctctattntcacntccngtctacngnnancgtccntntcttcactntntttatcagacatcagactanntctcnccncccanactttntcttatctctnctcttacntccnaccnctacgtcagtatctctcccacntcnacntactatatcccnntctccntctcntnnctgntatntctcgaatacnacaccgnctccatnntatntcnttatcattancntctctctacgctactcnccacnctnaccntcctanttnnccnctctacttgttctntaccntgctnncgtccactctgncctctnatctcttcnntatttactctaactgntctatcctccncctcacgntatcncncgntcactntcttannaaatnatgcnaccaatctctctcnnnantattcngtatatccgtcactatncttacnctcncatntcatcntaccacntctctgttnngtcactcnnncnccctcaactctcctccccataatntncacctcanactncaactntncgtccttcccatacctncccncttncccca

SEQ ID NO: 2088 - DNA, 920 bp, Homo sapiens
  misc_feature (1)...(920): n = A,T,C or G
ngtannnnnaaggnnttgnatcntnntantgaattttgaatgngnaactnnngcatntgnttganaccttccaaaatggccccagtgatccnatctcctaataagtncatgtnngtgnggccntatncaacactgcttaggaatgggcttncgnaaacccaattggtcccttgaggntgtgatggcaatntgaccttttnaaggctnaaaattgtaaaggaaaagaacactggggnnttncccttccnttggttggnnttggggaaccgctttngcttcttgggaataaagcccattaagntcantgttccnnggaagggataccctctannntttggcccattttnggnaanangggtggccaccaatnggtggaannaaaaaatggaaggccctnacntngcnccantngaacctattggttaaaagttgannnccnatccaccgngnaagnantaccnccccncattagcccccttnaatcnagccccctttcngaatttacttggcccccctttnngntaagcnatttttgngnactncaantcccnattgaaatntnggccccaaagcccaanaattttccccannaaaaangcccttnccccaaattttctgnttcccnaccaaaaaaantggttccaaaanaattaaaaaaatnatgnccccttaanttttntngganttanttttngtnggcnttggcaggttactaataacctaaatctttnccctcccntttggaaaaccnttttttttttggccggggcaancgtgggntttanttgnnttngtaagccccaattanttttngggggcccannggngggtngnaannncccccggnttnggatttagnaaatatcccaccctantttgtnaaaanctnntttatttnaaaanacaaaaaaccggnngng

SEQ ID NO: 2089 - DNA, 769 bp, Homo sapiens
  misc_feature (1)...(769): n = A,T,C or G
cnnttnnnnncgaggcacgcccccttttctccgccacttcaccagtttctgaaatccaacctcccagacttcacaggaagatagatntncttgagataatgaaaagtgatntcttcncntncgaaaggaaaaaaggttgaggtntatatgatttttaactgtattaggggtgtatgaaccagtttaaaaacgaggttttatttactgtagnagatgaatgcaaatcagaaccaatgatcccttggcctacttagttaaaaccagttcatacatcccttagggtttttattattatcattattatcattacagctgttatcgttgtttttgctgttattatnatttggggttncttggtgttttttctttgcgactctccacacttaaacttgcaatattgtggggagaagctgtgactaaactctacgctgcggtgagatgtagcagcaatcagctcccaccgacgtgtgtanctggggctgccgctcgcaataatcctattgatttaaagcttacttaccccttgatctgtnccctcntagtccatanggtcttgccacattttatttagtganggnggagaaacntatttatttgttngntggntttgccccttcccccnccccccaaanattaaactggggaaaattngngaatttgcttnaacctctcggggngaaatcnatacccttnattttgccatggnccnncctaattgggtttcctatacaattttngggtngaatnctcttttctcccnttccctcnn

SEQ ID NO: 2090 - DNA, 1058 bp, Homo sapiens
  misc_feature (1)...(1058): n = A,T,C or G
ttttgnaancccctttttnnnnnnnntnncttngnntnctttttttttggcaangggaatncccccatnnnnnnattcccgngcnnaaggnnnnnnaaaaaaaacggnaaaaacccnaaaaagggngggaaaagggcccaagggggggtttgggggggcccccgtggggcntttgaaaagccccggggnnttncccccaaaaccaaaaaattggcntttgcaaacccaaaaaagccttttggggncngccngcngggnncnnccgggcttggtttggcaaagtctttttcccagcccttggggccctgggcaaaggggggggccggggggtgggggcngcttgccaaggccgggggtngctttcttcgaacgccactttggcttcccggaagggcttgcgcccccggcngcccttgggaaacccgaaggtngggaaaggaaccnggttgggtggtcaacccttgcttcggcccttnagcccttgccgctgttggggggcgccgttggcaccggaacnttncttgcctnttctgttccgaacacccggcaatgcaagccggagacaaaacgcctttaaaagcccccggcccagccctgcangtatattgcaggggcctgggggcnggccctggaactggcgggccggttccccaatgggggtgccctggaaggctgcccgggcangagtggaagcactttggggcccgtgcccaaggccggtggcttgtgaagtctagttttttggctttaccaaattgttacaanaaatggcattttaacgttttcttnttgatgcctccctttgaaggccataagaatttaagggggcttttttttaaaaaaaaantaaaaagaaaaaattggaaaccccannntcntannaaanttctcactacntctntnnnttnntaacnctctntcnttctttnncacanttctnnattnnnncctctcttncttcctanaaacctttnttncangnccntntnnaattcacnnntcncntnttnanaaacaatcccntctcntntntctttggtcaccnanactccttttnn

SEQ ID NO: 2091 - DNA, 811 bp, Homo sapiens
  misc_feature (1)...(811): n = A,T,C or G
cnancctttgaactcccngncttttgcaggatcnnnnngnagnggnncggncngagatcanatggggntgaanagattttttnccagtnatgnnngcccggnctttccagntgggcccagtnatcanccatacatagttcatngatacacctccnccagcgggtgaggaaatgatggaaaaaggagnaagaagnggccatccgttttaaccatccctcctggattngtcctcaagtccccaactgccaagnaggatgtgnccatgtataaatgtgnggggcatgactaaagtacccgtagctgtcctttatatncattcacctagaaagatctgcaaagaacncaaagaaaattgaccatttaatcagtaaangtgtcccctgggctagcatggcgctatagaaagtggacaggctttanagttaagngaatctgggctcatatggtagtgntgctattcatnagcnctatactgntgaacaaatngctnaaactatctaattttggggntntttttnccatcnnaaaanaggggataataatanctncctcataaggattaatcggggagaattnaantaaccttcacntatagncagaaaanttcacctacccantccctttcntctnacttcccttggccccttcattaaaagactaaatnccaagntaagccattccannatggggnanaacattntttantccaagtaaaaanaacaaccctttanctnatcangtcttggaanctttnaaaangccagnaccncncccnaaagggnctntcaaaaaaggcaaaatccccagcccn

SEQ ID NO: 2092 - DNA, 796 bp, Homo sapiens
  misc_feature (1)...(796): n = A,T,C or G
tnatcctttcaactcttgttctttttgcangatccnnnnnntcgaattnggnacgaggttaattcattcctttccctganngagactgggctctgggctccctgcgtggttttnatgaggagcagaatagagctgcagtcagcagggagcagggctcattctggggagcagagacaaatagagaacagtatctcttgctatatgcagggcactgcaacttacaaatcacagcgcatggcgaggacgagggttggggtggtacctctcaccatgtctccagctgttccaacccgtggtcaatgggagctctgatgcaggctttttgctgctgggccttccactcctccaactttgcagcagtagctcgattagggtagttaatccggcctagcagtgctttggaggcatccagcacctctgggaaagagataatgtgagtgttgagcatctttccctttcaccctccaccacccaactggggatgaagaaacaaagaagccagcgcttagaggaccagggtccccacatcccctcatttttccaagtccttgttgnccacatgttctgtcctctgtctcccacctttctcttttgtccagntcattgagagtttcctgcagaatcttctgcctttggtctgatgggggtccaaaaaagggtggcttccctggattggnggggaacnaggagtcaatccaaggcctttanaactatnagtgagtcgtanttacntcnaatncnanacctgaaaaagatacatngnattangtttggacaaaccccaactagnaatgcn

SEQ ID NO: 2093 - DNA, 946 bp, Homo sapiens
  misc_feature (1)...(946): n = A,T,C or G
ggcnnttnaaacccttcngctacttgttctttttgcaggatcccatccgatncgnnttcggcacgagaatncctttaaatccctgggcagcaccgtnggggacaggatttacccgncaacagtggtgattctactttctaaaaaccctgagcccttttgnggggngcaccagatnaaacccggggggcatcattgaacatgcaggggcagattgcagaagcttcagttctgggaaaaagagaangngggggactttgttttgctgngcccctctcttccccgnggngaatggatctactggtgtagggggagggactttgngcttctactggtttcaagtacaagncactgggcnnnnntggagaagaaacttttgancaggtgcnncgangaagggatgtgatttgggtatttggcaccatcacccctcaatcagnaaccttggattgcttaccctaccaggtggaaagaatggggncttccttaaaagcctcttggggaaaccccttaaatttccaaccttttttctttttttaaaatcaagccttccgaaaaggncattggttncctttaaaaatggaaaagcnttatttccatgggtaaatggnggccttttttttttttttttggccccgccttttttctttaagcccaaaataaggattngggcctnggaaattaagtccnccaggaattaantttttgggggnaaaaaatttccattgggttttnaaagttancccaancttaacccccttttnccttttttttnaanaanaaatttntttaaangggggaatttangggnttnaatcctttcctttcctaaaaccnggggggggcccgggtcccncctttaaaanggggttttncanttttaaaatccttccgaancctggggangaaggggggggaaaaaanancctngggataatttttcctancn

SEQ ID NO: 2094 - DNA, 827 bp, Homo sapiens
  misc_feature (1)...(827): n = A,T,C or G
ttatccttaaactcttgttttttgcagatnnntnnnacgattnnnncgaggctgcttcggggactcagccatnttgctactgaggtgctgancgccgtcctcaaggntctctaccacctgctgaagcacgtagtgtgtctggagcccgatgacgtggccaagctccatgcccagttggccctagaagagctggatgacatcatgaaaaacttcctgttccctccacagaagctggagaagaagatcatggtcctgccgtagacctggctccaaggacgtggaggaggcaggcagggccaggcacccagagcccgtgcccaggtcttccagcaggtggccctgctgcctcttgagtgctggcagcatggctgaccctcggggtggttttatggtgcangtcacttgggtcttcanggtcccttccgagggcatgtgttcagcactcccgcgtttcagcctgaggggtgtacagttaagaagaagacagttacagatctcattaatctacatttttcactgtcctctancattgaaagaaggatgtctacctggtgaaagtatattttaacatgactgatggaatttcactaattgcccactcttcttggnacttgaagganaaagcgggttggccaccccattttgtcacctaacctctatanttcttttcaggcctgaaaaattctttcnttcnnggaaaaatgaaggaaccagaacntgggccnccctttggcttggttcanaaangcattttcannaattaaggaaaatgccaattttggaagttgggggaaggggnaaaggnaaatantttnttcnaaataaat

SEQ ID NO: 2095 - DNA, 961 bp, Homo sapiens
  misc_feature (1)...(961): n = A,T,C or G
gcaggatnnnnnnnnnncgaattcggnncgaggctnacntaagtcaaatgcagtanacaatggatagtcatcacagatttttgtacatgggacttcacataccttaattgaatatccatcgtgtacaaaatattgctcaagcaatgtaggaatcaagggaataaaagcttattctgatnttatagagcatataacagccatgtaaatatgcatggtatagagaaatcagtctatgatggatgtccagcaaagttgcagagcattatatanagttgcttttgatatgagccctanaataaattgggatagagagggagttggggaatttgagataattttcaaagaaaaataaaatatggggacaaaaaacaatagataacaatcaggtggataagctatattttgaggtntttaaaaattgttttttacaaattaccccctngtttttggagtattattatccttngcccaaaattcatttccttaaataaaaatattttggcctggaataaaccctggnggtggggnaaataaccattaaaaatggggttaggggtaaggaaaaanttttggggaaaagaaaatcccctnaccantanttttttccaaggttnanccatttcctntggggggaaaaaattccatggccttttaaaaaaaatnttggaanaaagnttnnaaaaggngccctttggggannactnaatttnttaattnccccctaataaattttgggggccccccattaattngggnatttggnccccaaaattttttcccnttnggnaaanccccccctttaaaccattggcttttggnaaaataagggcccattgntnggggnaaaccctttccttnaaatanaaaaatanttttnggngggnaatcccaaattggggaanaaaancccccntnnntcccnnctccccnncncncncnncnnnntnnnncnncccccccc

SEQ ID NO: 2096 - DNA, 828 bp, Homo sapiens
  misc_feature (1)...(828): n = A,T,C or G
atccntnnnnncanttnnnntttnngagcagggatcttataaagggcntnaaataagatgtgtggttcacatagatagngagcgtaacatctgtattaaacataggagagaagtttataaagggcattggcaataaactctttgttgcagctgtnttccaagcagtgtaaatactttttcctgtgattatgtatagccttggaatggcaccttttaactaacccatatgtgtttggtttcaatggntttttatatncagatgtatatatggtgctcacttttaggatcagcagtgttnaccatttatgctgcatagctgtattattagccttattagttgtgtggttgacccctnggggtataccaaatgtcantctgagtggtgtcttactcctttgtttataagtgaatgattgccatgttntgtatgncatagtatgccgncacataaaaagggagggagccgaaaaaccattacattaaagataatatttggacccaactactttacttnctctaaacantnctttntccccnttaacctnnccntcnaaaanttgcnatatagttaccagcnattgntntaaaantaaaatnttggtgggnaaaaacagcccttgggnctcttcccnngaatggnggggncttnttcntaatttnntcaaannttctggtcccctctcgggccaatttcnttttctgggtnttttaaaaaaaagnnggaccaannntttgcacccccctntttttaaaaaaaatatncttgggcgnnaaccccatnttaaananantaattccccccccacgtggaanaattggacgttnncn

SEQ ID NO: 2097 - DNA, 868 bp, Homo sapiens
  misc_feature (1)...(868): n = A,T,C or G
taatncttnnnnntnnnnnnnntntgcangatcnnnnnnntcaatncnnnangaggggactcgttaccatcactcccaccacaggctccgatgggcgcccagatgcccgggtccgcctcgaccgcagcaagatccggtctgtgggcaagcctgctctagagcgcttcctgcggagacttcaggtgctgaagtccacaggggatgtggccggagggcgggccctgtacgaggggtatgcaacggtcactgatgcgccccccgagtgcttcctnccctcagggacacggtgctgctgcgtaaggaatctcggaagctcattgttcaacccaacactcgccttgaagctcagacgtgcagcttctggaatacgangcgtcagcttgctggcctcatccgatccttctctgagcgtttcccagangatggacccgagttggaggagatcctcacacagctggccacagcccgatgcccgattctggaagggccccagtgangcccccatctgggccaagcttgangaaaatgtgttggccttgccccccaattccatccanaccaanggntgcaaagtggccctnncattcctgtgtgtatttaaggggcctgggggaagggggaanggggcaaggaaaccttgggacctttgggtacttaccttnaacttgaagggtnggtggaacaccaaccccctttccantttgtcaagcaacttttttccaacccttgnccaaattgggttttcccccntcntgggggaatcctccaattttcatttttggcacttgcccattacccttgggaggtggangccaaanaaaaaaggggcctttaaccaattccttgttnttaccccanattggaaggg

SEQ ID NO: 2098 - DNA, 812 bp, Homo sapiens
  misc_feature (1)...(812): n = A,T,C or G
aangaaccctttnaactcccngnnctttttgcangatccnnnnnnancggtncggncngagattttcaatttggagcattaactttttgctcatacacagttaaataaatagaattagttctatggagacttngctgttactgnttctcttgggcagtgttagtattcaccctgggcagtgagtgccatgctttttggtgagggcagatcccagcacctattgaattaccatagagtaatgatgtaacagtgcaagattntttttttaagtgacataattgccagttataagcgtatttagactgtggccatatatgctgtatttctttgcagaataaatggttcctcattaaactctaaagattanggaaaatggatatagaaaatcttagtatagtagaaagacatctgcctgtaattaaactagtttaagggtggaaaaatgcccatttttgctaatnatcaatggggatatgattggtcaagttnttttttccagagttgtngtttgccaagctaatcctgcctggttttatttatatcttgntattaaangttcctnctccaatctgaaatacttttngagtatggctatcnatacctgcccttttaagttngaaactaanctcatacattgcaaaatattgggttagtatttnaactaccatctggccncnnctcancaaatttccgattagaaccttttatcccagctagnggcccaaataattngancaanaagcctgaattgnaaaaaaaaaaaanttngangggccaccntcctngggggntaaattaaaancatntcgggn

SEQ ID NO: 2099 - DNA, 744 bp, Homo sapiens
  misc_feature (1)...(744): n = A,T,C or G
nctcaatcgcacgaggccatgggcactgtgagcctgggccagctccccctgccccccatccctcatgtgttctcagctggcactggctctgccatcctgcctcatttccatcatgcattcagataattgatttttaaagtgtatttttcgtattctggaagatgttttaagaagcattttaaatgtcagttacaatatgagaaagatttggaaaacgagactgggactatggcttattcagtgatgactggcttgagatgataagagaattctcgaactgcatgtattgtgccaatctgtcctgagtgttcatgctttgtaccaaatttaatgaacgcgtgttctgtaatcaaactgcaaatattgtcataaccaacatccaaaatgacggctgctatatataagtgtttgtcatatggaatttaatcgtaagccatgatcataatgttaactaaataactttatgtggcactgcctagtaagggaactatggaaaggtttggatttctccaaatctgggagaattttcaaaataaagaaaataacctttatatgatatactatgactaggctgngtatttcttttcaaggggatttttctaccttcangggttgggatgtaggttaattactattaccattagcccanccggtaggttttacatatacaattttctttggggagccaataaaagntcttccattttaccaaaaaccatttttaaatgtaagttttggaatant

SEQ ID NO: 2100 - DNA, 725 bp, Homo sapiens
  misc_feature (1)...(725): n = A,T,C or G
agnttcgttccnacgagaggacatgaaaaggagtgaanngctaagaaaccttagctgtagtgtttggaattaacacttgggaagtcatgattgacaaatagagaaatataaatttgttttatatcagttatatatacatatttataactgatataaaacaaattagattttgacattagaaacacatatacacatactgtaatatgtactttcttcattctctttaacctatattctggttttaagtttcctggagcccgtggagtaatgggacaggaaggctcagagggtctctttactgatagttaagatacaaaaaaaactaggccaggcgcagtggctcacgcctgtgatcccagcactttgggaggccaaggcgggcggattatgaggtcgggagtttgagagcagcctggccaacatggtgaaaccccatctctactaaaaatagaaaaattagccgggcatggtggcaggcacctgtaatcccagctctaggtaggctgaggcaggagaatcacttgaacccangaggcggaggttgcagtgagcccgaaatcgcaccactgccttcanactgggtgacagancaagactctgtcttggaangcgggggaagattcccnnnanaaanntnnnanntnnnnnntnnnnnnnnnnnnnnnnnnnnnnnccccncccccntaaaanntttnggggggntttntcaaaaaacccnaaaaaaa

SEQ ID NO: 2101 - DNA, 925 bp, Homo sapiens
  misc_feature (1)...(925): n = A,T,C or G
cnnnnnnnnnnnnnnntnnnnntnnnnnnnnnnnnnnnnnnnnnnnnnnnnnnnntnnnnnnctnnnnnnnntttnannnnnnnnnncnnnntnnnnnnnnnnnnnnnntnntcgcccnccccccnctnntnnnccctcccccnnntnnnnnnnntnnnnnnnnnnttannattannacaaggtangaatccgnantttattncttacanatgaagaatncatgnggagcttgcttaataaatcccttcccaccccaagcttnntttatgactgataactagctccagctggctttannttcagtatccctagtgagctgactttccccatcttgctctcttctgcctacttttctgntccttctaaacattgtttgcactcattttgcatctggttactactaccttcttccccacgtaccattttaaagaaaactttccagccttccttgtnataaacttcagccttgccaccattacacagattaaattatagcaagaggttagttaatttcctcaggggtctgtaatccttacttaggtccggtttgccagaccaacactctttctgcaagtactaacctgcttcctacattggggtgggtatttaagaccctttaatggcatcttgcaattattaagataaatgagcaanaattattaacccaatttacattggccctgcatgttttttccccctgcataccacactanccctacccaaagccactgtccctgttgctcactggtgtaccatcatgctgacctttcaagttcttgggacatactatactatattacttcctaccaaccagactttgctcanttggttgcatgtattataataatccttggaactatgcccctccacttccccttcattgccaattaaagtcttttttccccttaaaaatcagcttacatn

SEQ ID NO: 2102 - DNA, 1296 bp, Homo sapiens
  misc_feature (1)...(1296): n = A,T,C or G
tnttnnatnnnnnnnnctnnnnnntnnnatanttntttntnnnnatnnactnnatananntnatnttnnnnnanntcnctantnnnnctccncnntctcctntnnanatttgtacatcnnntcttatnccnctcntntntntgntnttngccccccccnctaacttnccccccccacttnantatnnancnnncnccnanngngntnaannccnngggggggttnttattttntcctntngccccccccccattanaatncannttctnttattatgagcnnnaccaaantttntttggggtngancannttccattntcctgggggggttttttttatttanacntttnnccttctttcnccttntnagncctattcgntgantctatnttaatcttttcctnananttgncntnntnaatnnnnttnnntttntnnatccnnatctgnnccntccaanttnagtnttatattttaacnntnttccnatnacatcantncgctagactaaactnaatntaaaaaccttcatntgatctatnnatatttnantaatactcnnttnatttnatttanttatttctcnannnanttntaannctctatttcntatctntcnatttatatttcnntacnctnnttttcttcnnttcanntacantncatttttcatangcattntctactcnatntntaanactnttntctttnantgatcntnactttnnntccntccctaatnctncttcttcctcgntttcntncagnctgttatnntantnactactatcatactancatnctactcnatatngtntancacgatatctnnnnanancttnntnanctantnaactctnntnttantannctantatatntananannnntntcntctactnttccaccttnctatatntcttatatatanttactntatatnanatnaccnnattctannattntnctnnttacnngtncanntanctcatatntcttatnntcnntcntctatntaatcactntacttatactntantaatattnttattnannctntnacngctacnnntctacactntcttatntcntacgttacntganttanttcatanctgnatatgtntntatagnnttctganctanactnantattctanntantncttntccatncactnnttgctcntacttantattatnanatcatcntctcacaatganatcactgnnactntacttttntaatgcatatnttnttgtatttatcatcnactctcacnnntctntannca

SEQ ID NO: 2103 - DNA, 729 bp, Homo sapiens
  misc_feature (1)...(729): n = A,T,C or G
angtttcgtcntctgatgatnacactcacttaatancnnccgtttaanntgatgaatgtggctttttttcccttcactttantgntcaaaaantngtggctattgagnanatttcttctgattnattctgtgacancctgttatcngatcnttatgtaatctttcagnagattttcatcctttcatatccacattcttatgtggacttgctgaagaaacagaatatcagttcaaaacaaaacctaggccaggctggtctcaaactcccgacctcaggtgatccacccacctcggcctcccaaagtggtgggattacaggcatgagccaccgtgccgagccttccttgaagttttttgtttggntttgatttgttttgntttgntttgttttgttttgttttgttttgtttttggagatagggtctcactctgttacccatgctggagtgcagtggcacaatcttggctcagagcaacctctgcctcccaggctcaacaatcctcccacttcagtctaagtggctgggactgcaggcacgtgccaccagcccagctaattttgngttttgntaagagatgaaggtttgccatgttgcccaaggctcgtnttggaacacccggggcttaaaggaatctgcccttnttccccttccaaaagtctganaatagcaggtgtgantcatcatgcccancctcttggaagtttacttaaccaattnggaaaaacng

SEQ ID NO: 2104 - DNA, 761 bp, Homo sapiens
  misc_feature (1)...(761): n = A,T,C or G
antnttttcgaattcgcacgaggttgttgttaccgtgtgccantgtgtcccatgtgggttgtgccaggtagagaaacaggatttcaatcntcatgtacacagttcaaacccnggcttgtnnagccatgtgggctgggtgatggattcccgtgagcacaggccccgtactgcttccatcagctccagcccctcagaagggacgcctacagttggcagctatggctgtcccctcagtcattgcccaagttccagcatccttcccatgaactgctcaaggaaaatggcttcacacaacacgtntaccataagtntcgnaggcgctgccntaatgagcggaaactcttgggcatnggccaatctnatgngatgaacacactcttcacgctttntggacttcttnntccgagancacttnaacnaaaaanatggtatgacggagttcaangcacgctgggctcttggaggancgcccaaagaaaggctacanatttggtttggaagtgcctttttcngatactacanttattggcctggnaaaaagaannntnccggctggncatattcnagggattttcanganggaaaccggngaangactatnaagcctgggccaactntattgggctggannaanttctggaccttnttgaaatattccaaagncnaaaatttggacatttgnccccaaacnngcnanaaannctctggaaaaatccgacgnttttgaagacttccgaggnngattcccccctnggntgann

SEQ ID NO: 2105 - DNA, 1451 bp, Homo sapiens
  misc_feature (1)...(1451): n = A,T,C or G
ccnncnaacaaacnnattaagatnnnnntntatnntnagttnntttngnacaagaantnncnnntgttnantacncnnnctaanccnctcnnnttattntatntaaatctnggntaaaatccctttgnccccntnanntttanaaaaaaantatanattttagagagngactnganatccngngggntttttaaaancgatannnacanatnaannactacntnttgntagncnaaaatatnaagcnganaanatttnnnantntnnaagcgnccagnnatttnaannttnagcnaaantanncgtgaagnntnngatgacaatanntncnnnncacnannaatnaatcnacatantattntnagnntaaacatatacngcanacatcttnantatnacctnatatacnaacacactnttntcgntangatntntatctatacacnnnnatagaactatcgtgttnacantnatntantatanatnacatngcnncacatnancgagnactataaaantntcagnannactctnatanaagnacatatnattngncgntctatacatgtcaanaaacnacttagnatacacatgatanatacanaaaaactgatntacatccngatggntntataacagatantgaatngtagacaatatcttagaatatanatnangaataaaaaannactnatntaaatnaaanatgnatncatnaaananaaangttagatntcttagttcntacnatgngatcacnctagatcatatataagaangnaaatatcncnacaganancttnatnaaatatanctctcatnnatnntgataanacacgctatntacggataaattactaanntnatcgcanatanaantcnangtgtgcaaanaaanaanacatacctacatgncactancacgatacagactnntancgatcttnacgngngtcncatctatattttgtanantacnanacgananccntncgaatacaatacaancatatcnnatattgtatnatatatattntatagaaatnnaanngacttaangtgtcgatgtcaatcacntgnctatatgnnactganngnnancaaatacanttactacataagatatatnnatntaatatanacaatatattacatacattcnantatgnanacncgaantgtnaancactntanncanntatgacacaatcgnnaatcatnctntatnaccgaannataaatntnatatnnngaatagagacgacactataagatnanatgtagnctaanaanactaannntanncngtnacnnatatntcntcgatntaactgttagttnttannacntanttannatatnantataatntatngagacactcaaatnatatntacncnntnaacnntaatagtgnctanatatntaatnntntgattatanctannnna

SEQ ID NO: 2106 - DNA, 1509 bp, Homo sapiens
  misc_feature (1)...(1509): n = A,T,C or G
tntnnnnantaccntanntnatntccnatanntnnanncataattncaanntannttnnnnngnancatcnnanntggnggacgaacctannacgcttnncnntatatatactattatngccnncntncnnntatcccnccntcnttcnnctnttnttnaaacntaaaaacccgggggaataanatnnacacttccnnccccgtctaanttnttaccanaacannantactcttncnacnttttttnntncgaggtancnnatnttctacnaggggggntttttttnantanaaatttatctnncccttcnttaatntccattanntattncanctnannaatcttcactacattccntcantccnannntanaagtccancccnaaaccnangacntnnaccncnnttaaaacacgnanagatanttctnnaacnnatactntnctccnantntnttgttcaatctatncagnatntcntancactcaacnacnccantaannacntncgnatnatntntnataccantntacctaactntncacncnancacnttactctacatnnnacttctcatcctcgtatngnancnataattacanaatttacctctatccantgnttnncnnngtnttttaaataancttancatattatatnaaannctatctatcctaatctatgcatnnnatatctatnncttcctcacccnaactatcatnatnntctcctacnantnttctaccnntacatgnnaagannactaacgtnatnactcacatcnctacacntaanncctntnanctctancccaannanacnnnacacanncttacntatnnctancacantnatctcnntacnaannttactctantttcgagctanacgatantcaangtatnttnncatactctcccncnnctttttataattannnacnngaantcacanntctcaacnnaccctaanctatatnactatcnacncgantnntncctatnnttgtatncnaantanncatctncagnacnctgcnctaacncaatatctcntcactntgtaangaacntcactatttatcacctnannatancatttatanttagnaacnnntnatanatatacttnnctatctnnncnnaccttanctcnctatctacgntancnctcnnatcgananttatntaanntanacannctacantacgnattgcancccnacnanantatactacgatccntatgtgnattccttntntcccacnantnntnanactatcantatctattncgncgnacaccacncnaatncctcacctaacattnncacacacccctncntttcccatgnttttcaaanatacatcnnntcatatagctancgcatntacngctgcctctacnatctganggnttatatgcaaatnnatcatatacancntnatgcnatatacncncatanatacatnctccatcnnntatntactatntacncgatgcgccca

SEQ ID NO: 2107 - DNA, 1314 bp, Homo sapiens
  misc_feature (1)...(1314): n = A,T,C or G
tnnnnantnnntnnnnnntnnnnntnnnnnnntnnnnanntcntnntnaanncnncaatnattcnacataatactanngatgttcnnttnnnngaatnttancnntatctctcantatnnantannanatntatntnccccccnctatcttancnccnactgcatcannttntnntnaagnanntcgaatcggnncgnanntnantnantattatggccgncnagnananactnaaccaggatgtatngcagaanctacttctactcatnnatcaacntgncaanngggggnttttttaannaccccatctnnacaggttgatcnataccanggcttgggaagagcaataccaacaagatggctttcccanagactgaacttccgtacnntttacatcatnaatgcaaananctanccaaatcctngganaatncaaaattataannaagaacccttnaanctnttttatttctnactcgtntngtnnaaaagtatnctnctcnncgacnntcttcanatttctttactntgntactttnntanacnttnaatntcactgantncgngnntnacntatttngtgnattaacttatntatgtctntataaatcacantataatgttatgtctaatnggnaaantttatacgnnttacataacttnnctntannnctgtaacagttntcagcaactatcnnttatctngctnannctntactccnntacnatactaatanaaanctctntctnntaanacattcnntactnaaaganctanatnttntncatatnaattctaacntngactacannatnaatnnngatncatatatcnaatcntatacnatctcntcttcnnnnaaanancgcaaatnanacatatgtgtatnaaaatacnntatatatnncntttacnnnnttctatcntataaatnntntacntctaatcgtgggnattatatntatcnnatctnccattangcccnttnggntacnanatattcnnctnaccntncnacgntactanactanacatatctatntnccctctcntacgcanattattnctattcctcagatanttccaacgatgaggntngatacntnntnntttacgctnaanaantacaacataaatctctcntatcnatgtntnnanacaatcaanacattntcnctacttncgacacaacaactcgctntctcatnactntnncnactcactatntaatatanancagannnnncntatcatctaagcaccccanttntnccattantacttngttattacatcctctnctctctcnnca

SEQ ID NO: 2108 - DNA, 1456 bp, Homo sapiens
  misc_feature (1)...(1456): n = A,T,C or G
ncncncacnnttnacnncannnaacgacatctcnanntatannnnngantanntncacantncnnnnaactcnccccccccactcncccccnnntncantttaancancgcactttctgccttaaaaaagcaccnnntatactacagtgtaaacantatttnnttnacctcnantttgnngcngnccccctcnncacctcatgngggngtnttttttaanttcancatnnncccatntaantatcaatatcgnnantncacctcnanatagttgtnattntctaacttancaacnatacactacatacanactnanacntcctagtgcacntanacnnangcatacnnncatnntatcgcaancaacctantctctngtannnnacngtcatttnnnactcatatcctnatctatacaanaanncnctaantntatatctacgtannctntnacaaatcantaacnaanatcnnacntntacatatcggactnntancttacnctctcattntctttcnntnaacataccgtantnnntcgcaactatanatngacatatatncngtacnncannnttactntctcncaacgcatannnananncanncgcaaaanatacgcaacgcatntnntnacgcaangcnatccnatannattcatnnctnaactcntatcgctaaactnattcataactngatnacttaccctannatctnaccaatntatntgntcaccccaannncttnagnatnatcaattctnnnnnctctnnccnccnctanagaaatgnctttntaatctttnctnacgacttaccnaatctatgatntaanctctacatcacnanacantacannnacctanncnattcanaagtanatcntacnnacgcgttagnanacctancnacnacncatcaanantcgtcanacctatctatcgactcnnncgnacgtatnncacncncacnatcgcntnacacanacnacnacnntangttactaaccntctagatctcttcanaacnnnnnnaactcnancatcgtaatccacntattncctntaccaccnatcnatctntanttcnaatcgnatctacacntntactntacatctacgnatcncatcaantanacaanntanntccncatantnctnnccaatgancnaananacgtantangcnattncntcnttcncaacgttntatagntancnnangtccntnacatagcagnttcnntctanntnngatattacnatnntancacntattatccctntcacnttctattccnttnnaaatcnnatncctatnatnannccacttatcnnnccnatgcactanaaacacnatnnncctctacnncnatncctannannancatctatnacacnctnnacntacctntnnttaantncancnctnactnnnnccncnnacnaacacannca

SEQ ID NO: 2109 - DNA, 1107 bp, Homo sapiens
  misc_feature (1)...(1107): n = A,T,C or G
acnttcgtttngaacaatatgcaatgtgaagcggtcgcncgtgagtttagtaaggctgtgtacactgactacacactncnggnatgcatgagcnacgtgtgtgatgagngggaaatttgttttatatcagtnatatatacatatntataactgatataaaacanatgatantttgacattnganncnnntnnanaccatgcngtccaanagngctccctagnntntctctgncatngtangaagaccgtaacctnttntcactncnatgcaccttnaatgcaantcagacctatttccctccttggggcccccctnnatctgcttcaccanccttatttngaanggnagaacanttcancaaanggtggaggnggganancanngnnaccntcctttnaancnngaannnattcccctcccnngantngaaaaancctattgnccctctctaattaagnagagntcancacgntnanaccttntncnctangntnaaacnnactntanttnnncgcngggnttttcatatnntacccctcannctncaccccttcttnacntnctccntacnnctatccccacnatntcccaatcctaatntnnatannaantnagccacgtcngctnatcnnncacttcacacaacatnnatctncnacncacccacnnntntttntctctctcancntacntacatntcatcnaancacantctnacnaangaaatcaattcnannatnnctcancctncttnttntcntnnnanagttnnnnntcacncgtntaatctcattngtntnngactatcagctcncannangtgtnnnnncgacatctcatcgtaacacttatcngcnncncnctctaanncnananaantancngtttatatcncnctnnatnntntctacntntaactcctncntttncntgatttnagccntantctnttnangnctnaatgnttcatatatacatnncttttcgcncntncacctacncttcaatanncgtatnntctngntcanccnacatatactaatntannnncntntnntatatnctatattntctgctanctntnattcnacntnctctgntacgcc

SEQ ID NO: 2110 - DNA, 1475 bp, Homo sapiens
  misc_feature (1)...(1475): n = A,T,C or G
cccnaaccngtttnntttnntantannnnttnnccnannnnnnnnnntnganaantanacnacccntaanntnntaagcaannncnataancgnnanatcntanncttancntangcnnttannntanntnaatngnangggcaaanatnantannntttatnanncttnttaancttatttnntncccccccgantctacntacccccnacttcntaancnnannnnacnananaanaaanaccnggggggtcnatcacnttaatgagcncccngcatgnaatgtaaaantccnanaatnnttncnattttgcannaggagcnanangacnatatgcggggggntnttataannnttttnatncccccttactttaactanntccnnnnnnaacaatntnctncntccccnatnntantncncannttctacnnnanntnnnncntccttnntntcncgnancntattgnctttnnnnntaanatnaactntattnatnattanncncncgnnattaacannccgcatanacantnttaaatttnnttnntnttncttncctttntacnacataacntatntatnctnacntacaanntatnaatntaccnantaacgtctantantcantatnnttcatantcacactgactcngcnntattatanantcantantatcgntaacatntangnatacaacgatcgtatcatatcntacnntctcntatcactntgnttctangntactttanatatgcntaatantctnantactncttatntcacgtacnatatnacncntacgataantataacttacngatttnntcacntancgtatnttatacnatcatnttnctctcaccactactanccaacnnanatatnnntnaaantctntttctaacttaagctacccncgacgnatagncgatantatntananatattcaaactntnacnnntnncntnacatatctcacacantngnannctcctttttatgnanctaanatatncatntnnnatctantatcttatataatacantatnctcacactcatctantnatttcanncctntnatataccttntaanactctcnanatgntatcatcctcanccactctctnttacggtatttcctnnatncatcnntatgctacanatacaangtagtactatannacnctanctnacgatatanttatgtancncanatngctatntacncncnanncncgatagntacattatatttnncgtaactnaaacttatacnaatncgctgntntnatanactatcnatatctanagcataactnnntattatntaatacnaagctntnatctcgtnatgnatcacnaaacctntctatantcacntnatgtacnatatctatctatatctaannatacnccaaccacntntacgtattctaaccatntcttntataagtttcanataccca

SEQ ID NO: 2111 - DNA, 950 bp, Homo sapiens
  misc_feature (1)...(950): n = A,T,C or G
nnnnnnnnnnntcnnnnnnnnnnnnnnntnnnnnnnnngnnatcnnnnnnnntnnnnngngnantnnnnnnanttnnnnnncncnntntnnnnnnnntnnnnnncgccncccncctnanannnnccccnctcnnnnnnntnntnnnnnntttnaantacaanttcggcacggaggataaacatctttttattcaggancgctgcgnacnctaacnnncnnncagggntcatgggattgggtaccgaggngtgaggagggaatctgcaatnggcttgntacaagagaacacgcccttttctctgnagatttccgccccaagtcgtaccatactctttaacagggcacaaacgtcagcaacttcaagtttcctgtgaggatnaacatccagagtttctaatgactaatctccatngtgcaaaagaaaaggcntaacctcagccccttnagacagcttatgccangagaagttcatgaggtattntaanaaaggctgtngttactgnctctatttctnggngagcaaggaggaagactgtnactaatatttnttggaatacctaatntgtaccacacagtgttcccagagctntaganatattaactcacataattntctaaataacttgaagaaggtanataggaatttttanctccattttacaaantgaaaaaacataatgacagngattgggtgacttgcctaangggcacacaggcntcatgangtaaatancaaatttagctttnagcctcagaatcttaantcaaaagcccttatgcccaagcnccgcaaaggaagannaagaaaaatccacgganggttnagtttggtngnaaacngantgaanggntccntggggtgtaaaatggagtngtggaacccctggagttatttcnaanttnttctttntttnctgaanaccccctagggccaaaattnggaatggcg

SEQ ID NO: 2112 - DNA, 710 bp, Homo sapiens
  misc_feature (1)...(710): n = A,T,C or G
antttcnttggctgcttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtcaggcagttcctgctccgactggggctcctccaggtggtcagccagattatagtgcagcctgggctgagtattatagacaacaagcagcctattatgcccagacaagtccccagggaatgccacagcatcctccagcacctcagggccaataataagaagtggacaatacagtatttgcttcattgtgtgggggaaaaaaacctttgttaaatatatggatgcagacgacttgatgaagatcttaattttgtttttggtttaaaatagtgtttccttttttttttttttggaaaatgcnaaantntttntccntcntgatggggggttantttttttgtgnaaaaaaaaaaatgggttngtttttagttttaaggggaaatgccccttccccncaaaggtttggcaattatggggngnagccttgggganaaaaaggccttttnaaggaaccttncctttnaaaagcctntttgggcttccaataaangtttgancccaaaaaaaaaaaaaaaaaaaaaaaaaacccct

SEQ ID NO: 2113 - DNA, 815 bp, Homo sapiens
  misc_feature (1)...(815): n = A,T,C or G
atntttttcgaattcgcacgaggttgttgttaccgtgtgccccgngngaangacggacactgtatgccacnatgccnatntttagngcattttcctgatccaaacaagctngattgttttcagctaacagtaaccccagatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgagtttattgagagaacattcaattgatggcactggctgggctcccacaagaacattaaaggatgtcngtttggggattaaactctttgntttactgatcttttgaattttgatgatccactgaatattgaagctgcagaacatcattttgcnggacaanggaggacttccggaataaaagtnggattgactncatcaaacgttatncncanatgataaaaaggggacctattgcagggcccnatgggccttnngcnacaancttgtcttcttaccntttaaaacnaagtnatggagggtnggccccccntttttccgganntttaaagcctgcccttttnnanntnccntgggnnttngccccccanttccttgganaaccctgtttgccccttcaanaaaagaaaaccattttttcatagaactngcctnctntttgngtnttttngaggaaattttttnnattaaaataacattccnnnaaaaangctntttagggggctttnntnaaaaangccttttcggattacccntttannn

SEQ ID NO: 2114 - DNA, 898 bp, Homo sapiens
  misc_feature (1)...(898): n = A,T,C or G
ccncctnccntngtnnnncnnggcgctnnntnnnngnnnnncnnnncccgnngngngncngngncgngtnnnntnnnnnntntngnctnnnccgcctnnnngnggggncnnngnnnannnnnnnngggtnggngannnnctntcgtnnncctncnngcnngnngnctcntnttcncnttngngnntncgcgnccccccgcgccnncnntntnccccccaccgcctntcntnttnnnnnnnntnnnnnnnntatnngcncgtntaaccgtnnnctcntggggggggggtntnttcatntttctcncnncnnnnngggcncnnccccccnnanntgnngncgantnnnnnnnnntnnnnacgcgagagncganncnntncntcgcntnctnntntgncggggnggcnntntncnttncgccatcngggggggntttttttnntggngcncagngcccncngtnancntcncnctcgtngggntgntgntcnnccggtcntntcccntctcnnnntctctanttncgttnnaccnttttcanntnnnngntcctctcncntcncnccnccnnccctttgnacnnctnnntnantnanctnnnntctcncgctngcncgnnttccagtnnngttanncctgtcncnnncgcgnnnactncnnagngtgncntgccnncttngngtnccgncnnnttgccgnatatntnncnntcnnncnnttggcnntgtcnnnantntagncctnngcgntncgtannnngcactcctccgnnnngtngncnncngtacncgncatccntnanntgcgtcnnnctcngannncanccncnntntctntngcnntnnnnnncctgntnannatntctctnnganttntnntcnatancggggtncgnttncg

SEQ ID NO: 2115 - DNA, 1351 bp, Homo sapiens
  misc_feature (1)...(1351): n = A,T,C or G
tccntangcaacgatgttantnncnatcntgcatcanatcnttactacacatctatctttcnngcgtacctnctacagaatntntantcaccncatacanctantnntctatgnccccnccnnctttacccccnccccntannanncntnnaaacntgaanccnggggggtnttanttancccttggccccccggtanctnttatanaaaaaatacgtaanantattnaagttttnngtgnctacnntnnanccatntgtgnggggnnntttnttnnanttcacgntccacctttnctnaacncnanncttnatnacatnannagnngacacntcaccntcnacannacttnttngttatntttactaannnattganaatatcnctactnattctaactggngnctacncttgngannnantgncgnnnnancacttccaannagaacangntttnacaacagtantgtcnactacnnnnantnatcgatcactntatnantnnacnttttcnttatctctanntactngacttttcctacnanttccaattacnnntnannanctncncttntacttantccttancactananatcncncacaacnantacacnaantaactntacnancgncntattaantaagctaaggaccgnaacnatcgacntatanncacnctacnttntatntacnntcttnantaacnaaatntancataggcganaggnatctacactanacncatatccttgtccaaaagataccctaatggnttacgctacgtnncgatctccaacntaatcttatatangntatacatctcttntcacgatactactntacgtatacanattgctcgcnacttcacgntatntcactnaagntatgcccntntctncatctgnttatatanngcnattcaaattncngctctcntnaatgtaactaannttncgtntcgattgncacncttanntagcntatgncaatctnntnntnnntcatatnttgacacnnanctntgggatatctntaattttgatcacntatnttnaattangtacgcancgnaatgtcttctantgtacgtgctataatntatnggnctgtaccgtnactantgtnctcaatttatctcacatatanacactatatcnaagtangntncaaatnatatntacngtanntncctttacnananatnactatcctactannattatactatttaanngacantatcanctntnngnacncnacgacgcncnctatacntanntacnttctattacctatnntctcaccctcctactcatcnaaantanccatgtntacacangnaaangca

SEQ ID NO: 2116 - DNA, 705 bp, Homo sapiens
  misc_feature (1)...(705): n = A,T,C or G
anttcnatcgccgaggcccgtttgcaaaaatgcagcaaaaaagttacttagtctggctgtttagtagaatttacctctactcattcatcagcctctttatatatatgattttaagtcttttcattgcactgatcactgatacatacgaaacaattaagcaataccaacaagatggcttcccagagactgaacttcgtacatttatatcagaatgcaaagatctacccaactctggaaaatacagattagaagatgaccctccagtatctttattctgctgttgtaaaaagtagctatcaggtttatctgtactttagaggaaaatataatgtgtagctgagttggaacactgtggatattctgagatcagatgtagtatgtttgaagactgttattttgagctaattgagacctataattcaccaataactgnttatatttttaaaagcaatatttaatgtctttgcaactttatgctgggattgtttttaaaaaaactttaatgaggaaagctattggattattattatttcttggttattttgccatggctttagaatgnattctgnatgcctctcttttgctctgatctggtgctctgctattctgatgggcaactgnttaatagtgggaaacaatcctgggctgntgggctttggcaactcagaccctgnttggncctctcaggagtcatcttgaaagagt

SEQ ID NO: 2117 - DNA, 737 bp, Homo sapiens
  misc_feature (1)...(737): n = A,T,C or G
aagttcaatcggacgagacccttcttgtcgtatctccggtgtgtatcagctctccaactctatgtcataattcagttcatggggatcttgattacctttcccttccacaaaatattacactgattggttatatcgatgacattatgctgatttgacctagtgagcaagaagtaggaactacattagacttagtggaaagacatttgcatcagagggtaggaaataaatatgactacaattcaagggccttctaccttagtgaaattggtagggacccagtgacatggggcatgttaggatatttcttctacggtgaaggataagtacttgcatcttgctgctcttaaaaccaagaaagaggcacaatacttagtgggcctctttgggttttggaggcaacattttccaatttcattatgttacaccagcctgtttaccaattgactcaaaaagctgctagttttgagtagggcccagaacaagaaaagagtctgcaacaggtccangctgctgtgcaagctgctctgccacttgggtcatatgatccagtggtgtttcaatggcagtggcaaataagggatgctgtttggaagcttctggcaggtccctatangtgaatcttggtttaagattttagagccaaaacccggccctttacccaacaaaataactagtcttttttttgagaaaacaagcttcttgggcctgctactggggccttaataaaaantggatnc

SEQ ID NO: 2118 - DNA, 738 bp, Homo sapiens
  misc_feature (1)...(738): n = A,T,C or G
agttcntttggaacaatatgcaatgtgaagcggtcgtgttgtgagtttagtaaggctgtgtacactgacacctttgcaggcatgcatgtgcttgtgtgtgtgtgtgtgtgtgtccttgtgcatgagctacgcctgcctcccctgtgcagtcctgggatgtggctgcagcagcggtggcctcttttcagatcatggcatccaagagtgcgccgagtctgtctctgtcatggtagagaccgagcctctgtcactgcaggcactcaatgcagccagacctattcctcctgggcccctcatctgctcagcagctatttgaatgagatgattcagaaggggaggggagacaggtaacgtctgtaagctgaagtttcactccggagtgagaagctttgccctcctaagagagagagacagagagacagagagagagaaagagagagtgtgtgggtctatgtaaatgcatctgtcctcatgtgttgatgtaacccgattcatctctcagaagggaggctggggttcattttcgagtagtattttatactttagtgaacgtggactccagactctctgtgaaccctatgagaaccgccgtctgggccccgncatgtncttancacaaggggggcccnccgttttgagtgaaggtttcttganctgctcttgaaataaanccttgcttggctgcttgggccttgggcnttaattcaaatctattgaatgcttgttgncccacgtttt

SEQ ID NO: 2119 - DNA, 685 bp, Homo sapiens
  misc_feature (1)...(685): n = A,T,C or G
ttcataagggctctagaaaaaacgagttattcacaccagcatcatcttaactaacattctgaactagttagtgcagcttttcattgtgttgtgtggttggtctcataactaggttgagtttttctcctctgctgaggaaacagtaccgaagttctttttcttgtggcatttgtattataaaaacttggtgtgggggaggagcacaaaactccagcccactgaacctctgccaattaagatggtgttgggttaggttacatctggttactgtcctgggaaaatcatttttatagagatggccttccaagtggttttaaaatttactgaagtttttaggtcaattatgtatgttgactaaatttacaaataaacttgtttatccaactaagtgtccaaaacctaaattgaatgtactaagttttcacatgtcccattatctagnccttgnatactaatgttttgaacttagatcatttcangtgttgtttggtggataaaggaaccttttatttataaagaatctgtagaaagcatgtgaacaagctctctgcttgattaagangccataatagtgctgtatttgcagtgngggctaagacaaagtatattaataaagctttcacccccccactcccgttccctantgnanaacccccaggtgnanaactcagtcttaaacttcagt

SEQ ID NO: 2120 - DNA, 763 bp, Homo sapiens
  misc_feature (1)...(763): n = A,T,C or G
agtcnaacgcgagttnnctagcannttnctnagcaatnggcatgncatgtagagctccnangatttgttaccatcctgcaacaggagccagaggagaatatgcctcaatcaaaatcaggctaaaaatttgtttcaattctgcgtgtgagctgggaccttaagtctttctggtcgctatttggtaggggaccaaatgtggccagtcacactggaaaagtttattttagattgtcccactttgtgacatgcactaggatcttttcatgtggagagttcattttttccctatgaagaaagagattcaattagtttattcattttgtaggtaattttgagggcattggggaaaacagaagtaggtggtccctcgaacaacttgtacaataaaatattttggcctcaatttgacacaaaatgatgttgacattgctgcacataagtcccatggaaacttattatgttataaacaacaagagacactcttagaagggaataccttggctcctttncagtagaagttccgaattctggagaaacattcgactgcatgttttctagcaatgagatattcgattcaagtccttggagtgtatgggggggtttcaagtttttgnttggagttggnggctttttttttgaaaatnccattagngggtagnaaattttcaaagaatgggnccccagtaaaaccacttgggcccagtcntttttggacttcaagtggaaaaaaaaattggggtttcccnggggggaattttccctt

SEQ ID NO: 2121 - DNA, 816 bp, Homo sapiens
  misc_feature (1)...(816): n = A,T,C or G
agannnagtagaagggctcctttcctaaatccttgacgattgacaacacccatttttccttttgccgaccccaagagttttgggagttgtagttaatcatcaagagaatttggggcttccaagttgttcaggtcctctgacaccttttggtatcgttaattttactgatttgtgtagaatgtcagttgtattttaccagctaatatctagaaatgctggcaagaggggtttactccagctttagattgtaggtatgttagcttttttcatacagtgtattaaatttactgagtcagcttgctgaataagacagaagcccaagaattttaacagtgtgtagctttagttgtctaaaagttaggccttcgggcttcaaaagttagtggtcatcgaaaagcattaatctttgcagtttcaggtacaacacattggntttgattaaggatggggatggggccctctttttgcagaatggggaaaagtattgacaggaatttgagagctattggtangcccagtggtataaaggtattgtgaaaaacaagaaattaaagttanttggtcttgnaagtggactggaaanccattttaaggctcttatcaaaggncctaaaaaaatttgggtaaaataatggangttttgggtaaatgcccaaaattggtgggccaagtngggaaccaattatttttaaattttaaaaaatttattgttaaaattgggcattaaagttaccttaagcccccaagttatttttttttaaatnaaaaaaggtttattttnntttaaaccnaaaatgttcaangtttgccantttt

SEQ ID NO: 2122 - DNA, 712 bp, Homo sapiens
  misc_feature (1)...(712): n = A,T,C or G
aaatgcantgtttgaacctgangaaaagttaaagtgtanaaaatattgncttgccgaaggattttgcagncctctgtcagtaacttccattgattaggcagacatattcaggtaaaccctaatcattaaaaaaaaattatcaatgtagaaagtaattcccttttttctctctgagatatacctcaatcacacacttccccacccccacttgaaacagacctcttcacttgtgtttttttttcctgaggtggagtcttcccctgttgcccaggctggagtgcagtgggatgatcttggctcactgcaacttctgccacctgggttcaagggattctcgtgcctcaacctcctgagtagctgggactgcaggcacgcgccacctgtatttttgtatttttagtaaagacgggggtttgccatgttgcccaggctggttttgaactcctggcctcangtgatctgcccaccttggcctcccaaagtgctgggattacaggtgtgagccaccgcacctggccaaaccgnttcactttgtaaaanaaattaaggctaataaaaaaggngtaagttttttganaaaatgaaaattttaactttaacccnttttcactaagtaaaatagccacaatcntcaatttcttccctttggnaaaaaggggggttacctactggggccctaccctcatattntattgaaaaaagnaattttgnt

SEQ ID NO: 2123 - DNA, 802 bp, Homo sapiens
  misc_feature (1)...(802): n = A,T,C or G
actttacaatccnacgaaatnaactcactattatanacanngagcacngcnacnatnagcagcatctagntgcagnctacgtncattgagaaggaggtcttccccattatggccaaggaggggcagctatatgccatggagttacagggcttctggatggacattgggcagcccaaggacttcctcactggcatgtgcctcttcctgcagtcactgaggcagaagcagcctgagcggctgtgctcaggccctggcattgtgggcaacgtgctggtggacccaagtgcccgcatcggccagaactgcagcattggccccaatgtgagcctgggacctggcgtggtggtcgaagatggtgtgtgtatccggcggtgcacggtgctgcgggatgcccggatccgttcccattcctggcttgagtcctgcattgtgggctggcgctgccgcgtgggtcagtgggtacgcatggagaacgtgacagtgcttgggtgaggacgtcatagttaatgatgagctctaccttcaacggaacccagcgtgcttgcccacaagtctattnggcgaagtcaatggccaaaaacctcgtattcatcaattgttgaaaggggnatgccaatggggggcttgggcccgaaaccccccgggtttttcccatttcaaaccaaangggggaaatggcttgggcccttgacaccaattcagaaaagaaccccttgggaccttgggcaatttaattttgggcctnggggggggggccacttggggttggaaaaacctttnaaaancttttttttgggnacnn

SEQ ID NO: 2124 - DNA, 1508 bp, Homo sapiens
  misc_feature (1)...(1508): n = A,T,C or G
cnaancannnaanncnnnctnntcctnnnncncatnnnnntcncnatannctnnncannncanncnannnnnnnnnannnnngtgtntcncnanncananagggncancgacncnaccnnancnncantnatntnnnantnccccccccntanncancccccccctcntnnnnnnnnnnanatgncgcttatcnantccnngggnnttatatnnnaccnganaanccgaagtcgatagaaatgaaaggcctgaaatttgcacgaangcattccatgttntttatagnaggcnaaggggcgnaaatntttgnggatggnagtacaaatgtgccttngtaaaatatgttgnaaanggatcatttcagaacccctngcnacnncgtgncanactntcannccnnnnattaatggaatttnccanctggtctccncnngcncaancactggcctnngnatgntggnnncaccngncggnggccntatttggcacnnngaaggcnannaaaactntntnncacacncgcnnnactcntncntagtnggacccctttnngccncnnannagnngcacnncgtaactantngnnntcnnngactcacccacactnanccatnacnnccacaatatntangtgtnnattagatgngataagtnctctcactcgatctaatctnncantcnctatannttcgaaaaganantgctngananctcnanatgcanactaaatnnncanacggtcatanaaanctcactgtntanctcgcctcgtctananaccgnanccattcnnatcanttacacatnggaannaacccncccananngtnaannncatacggggngacggggtaacacccctcntcttcacntatnaatngggnnaaaccnaaatnttatccaaaanantttttcttaatngtctntcnnncgntnnacatngaaatgntnagcctcngataagtttnatatncactganaanaanacgngactatncnnttcnacacntctcntannatcgcgaaanggncgaaaaaatactcgtannanacgaatancanncgctatgataccgnacgncacnannnanncnnntgtaanntttntctcactctnctgnccacataaannagatntaactancatntncacttnagggaaatgttaagnnacngnngtcaancgnaaacnttgacgggnggcatgcgtatattaaagaatnnananngtannnctnntagntacancnccactctcnggcganacgaagaantnattanaaaancnacagatngnnactataatgtaaattanatcgaacncngcacgcggcctcnacgttagtntcctcctcntnntcnatggntacncacgtnatcttactgacacnntantaattccnnntntctccagccnaaataaccaacctatntttatcntccatangctcancagcnatgcttatcgtctnncatctcaaaccgancatanctgnagccntcnccg

SEQ ID NO: 2125 - DNA, 805 bp, Homo sapiens
  misc_feature (1)...(805): n = A,T,C or G
tanccttnaactcttgtctttttgcagatcnnnnnnntcaattcggnacgaggtcagctcgggcaagccctccganaagaacctctacgccgacatcgacgccgtttnnnnggcnctgcgcncccggtatggcgtgagtcccgagaacattatcctctatggtcagagcatngggactgtccccacggtagactnggcctcgaggtatgaatgcgcagcggtaattctccattcccctctgatgtctggtttgcgtgtggcttttccggataccaggaaaacatactgctttgatgctttccccagcattgacaagatatctaaagtcacctctcctgtgttggcattcatggtacagaggatgaggtcatcgatttctcccatggcctancgatgtacgagcgctgtccccgagccgtggagccccttttgggttgaaaggggcttgggcataatgacatagagctttatgcacaatacctagaaagactaaaacaagttcatatctcacgaacttcctaattcctgaagacaacaacttggatcttacctcatttactgngaacaagaanantcctctgttttgcacatgctttaactgggtagctgnaaaaggctttgataccatgaaaaaatgcccaaccctttagggggntctaaatcaaaagaccttgatgaaatctcaagtctttttgtattctaaganggngggtcntgnttaattcncacaaacacgttaaaactggaacagtcgnggaattcccnncctttcattacccttgccaggaatngggaatgaaaaccn

SEQ ID NO: 2126 - DNA, 882 bp, Homo sapiens
  misc_feature (1)...(882): n = A,T,C or G
tancctttcaactcttgncttttgcangatnnnatnnnccnnttnnnnttnnngtcggatggtaaatttcagatttttgcctatagagggaaagttcctgtggttntnagttacagacctgccaggggagtcctgcagccagacaccctgtccattgctagccatgcatcattaccaaatatatggaccgcatggcaagccataacccccttggtggaggaactgaatgtcctacttcaggaatggcctggactgcactacaccgtgcacattctctgttctaagtgccttaagagaggatcgcccaatccacatgcttttccagggaaatctgctgtgatagagaactgcgtaacaggccttttctgtgagcgctcactcatacattatgcacgacgtggctaagatctttgaagcgcatggagacaggcacatctctgagaggggagttgctgagtcagcccanaccggaaggagtggcagagatcatttgccccaagaacggcagcgagcgagtaaatgttgcctnggtttacccacccacgcccgactgtgaatcaagccccctggttccaaagaangaaattgttgggtgcaaaaagccacangaaaacccagtggaccgttttcgnnggcctgntgggaaattntcccattgggannaaaaaaganaaagcnattnttgaaccaccctnggaaccaatntntttttgccancccttgggcaaaaacccctttttggnaacttcaacccccaaacgggggtttctgggggaaaccttngagttggnacnaaacgcnttgccttggcaaggggngggccntttctnngnacaaaacttggggggaaaaaaaggctngggggaaagnggggttttnntn

SEQ ID NO: 2127 - DNA, 1222 bp, Homo sapiens
  misc_feature (1)...(1222): n = A,T,C or G
caagngggggngagggggggggnaaaaattnnnnnattntttccaaaaaccnaattnnctncccgaaagggaaatttntnntncnccccaacanaanaaaanggtttttttntttntcnnnnnnnnnncaccaacccnnnncnnncnacannccntngnnngncgnnccnngncnnggnggggggggttttnttcncaaanntcnccnacaccgggggcccancgttaatattgtcgnnaaaantcttttnananncaangngggggcnnatntnanncagnncgngaggagaaanaancnnttaactnncacanaaangaggtctctccancgtgcnccnatcncccccacngctgtnanntgggncccccccccaaaangacccccccgccataatcctggcccnagaaaatacttcccnncngnagccattccccatcnctttcncctccngantcccnangccccnanggnganttttanantcccccaggtaaggtctnanatngannccncnagaatggnngnacccccctncccnggttgggagnnacttntnnngnaangggnangnacccggggaaancccnnccnccnccagccntggccataaaaaccggcccnaatccangnntntcnacccttccnncncannaagaaaaacttctaaancccccnaaanaancancaantcctnatggccccaaaanannnangccattaaccccccccnaaatttntccgctcaccccnggngcngnanatttaancccaccaataanacnnccccacgncccttcnggggggncncaaananngnggggngaatcntgnaaaaaaaaaccntcccccncncgcgccnaancgggggnacccnaacaatantcctccgcccantacanncccctccnnatantcccccccgcgntnnaaacnccncanncgcgaccanaccnccactcctctctcgannacaccngntnnggtgcaccgcgcaaaacccnccnnacataaanncacacccccccccnactctaccccccaccactcatnatncccnctccancnncnctccccccccnttctcatngcacncccgcnatacgcnacatccncgaactatgncgngnccccccccgtncacggacccngccccatggancccccctagatcnaggacncccccccnccggaatctcccccnggtncnaacaccccccn

SEQ ID NO: 2128 - DNA, 789 bp, Homo sapiens
  misc_feature (1)...(789): n = A,T,C or G
ntaatcctttcaactnctngnnctttttgcangatnnnnntnnnnacgaattnnnnnncgagagtagaaatagtcttttatgaaatnntatacttatggaaaatatatgactggtatatgattcctttagaggaagaaaatttcaattttcagattcaaaggaagcacccttcctagtctatatatatagtaagcggagaactagttttacagtgctcatttcaggtcttcagtaagtgtgtatgatgatgtcagaagtattcattggctcactttcaaatcactgaaaattcagccatgctaaggttggctattacgtgtattagcgtttccaagcgagtggtcttggctggggtgagattgtcagctgtctgttaggattagtcacaacaaacatggtgcaaatggtttccaacaacagcgcacttcaagggtaccttcataattctttctgccagaacccaaaaaacaatactcttgagctactcagtgttccaattgttaaaaatttcctgaaattttccttcatgtattcaaaggngaaacataaagatctagaaggatggttgtgaaaaagtatggactttatagtatctagtgggcattttcattgagcccaaatgataaattctgtttccaagtcttttaagtgaaaaaaaaaaacctctagaactatagtgagtcgtattacgtagatccagaaatgataagatccattgtgagtttggacaaaccccactagaatgccannaaaaaatgcttattgggaatttgngatgctatgcttan

SEQ ID NO: 2129 - DNA, 1481 bp, Homo sapiens
  misc_feature (1)...(1481): n = A,T,C or G
aancnccnnacnganaanganannacnncaccgacgcgannccggngcgangnnnnacnangnganacnnacacacacnnacgcgcnangaggnacncgcncnggnnagaaanangnagagngngcanganncacgagnggnnangacagggnaancacangcgagcangnncgngcacacacgagaacncacnnnccncccngcngcacccctaagnggaaaancccctttnccaaaaaannnccnggnnnnagnnnnanacacngangaacacgaagcacgnccccccacancgacacangagcagcnnnancagncaaaacnannaancngnncagncganncacgcnaaggcncnagnanncnaaaccgacaacaacacnanacaaactaanaaaaaaaacaacaaccnncgcnangnacagaannanagnaaananaacaanaaanaagannanngaacacngaacnanngncancaagcnaaanaanagannnnccagnanccncagcncgnaacaaganngganngnagnaaagccannggnnnnnannanaangcgaaacgggnannanaagaaacnngnngnncnaangaaaaancacagcanaacccnaaaanaanaagaaacgggnanggaangcncannncaaaaccgggangncanngcggaacaaancnaccaaccactacggggacangncancgnatacangccnganacanacgcngnananaggcgaaggcncgcacgaggaancnaaaacacnagnaanatngnaaaagaaannnggnacacacngaancnnagnanaaaaaaangcggganatccaacaanagccacgnanntgnnggaangnannanncnnagcgaccgaaaacnannngcacgggncagtnatggaangcnagcannccaccntgnncccannncnntcnaccnnngnaagntgaancngntcnaacgaancacgtgnaggnnctggncnangacncanggcacatcacacacagctctccacgaatantctgagagacagaagcggnaaaanaccncgcncaacncacganaaanacncncganangacgaccnncaaaacaanaccgcggaagncnagangacgannangggngacgcanntgncnccnacgacagacgnanncgcnaggngacganggaccgaagcacgacaancncgacaangacatgggcgggagccacacnacngngngcgggggaaaaaaaaaaaaaagaccangcacacgggnggcgcacgaaacagcnaggnngggananaannncnaagaacagngacgcaagaaaaanncgnggnggaaaantacaactcacgatattgaaaccggnggagggcaaaacacacaacgcacccnaaaggaaacgnacacgangggggggaggaaccacaaaacatcacacaaaancgnngggnagcncgacaacaaaaaaaangggngn

SEQ ID NO: 2130 - DNA, 1153 bp, Homo sapiens
  misc_feature (1)...(1153): n = A,T,C or G
gncangngaggcacgcgcacgnnggcncannaagngncgnngggnanncacgganngaannnnggggannccnnncnnncnncnngcnaaccttgcactccggctcnngaggaggncccacgccccnagcggcacgaggagaagcncaaaagcncangggccttnnnaaggccccnnanggaacccaggnaggggngnggagganncnnanagaaannnaaaaccgggaggcgncncncaaacggcancccggnngnacccgncccgncgaaaacngaaccaaanngnaggcgggggaaaccccganaagnggaaacgggggaannanaaacnnncggnancngganaggcgcnggggcacaaanaantcnaaacccntgagggaagggggccnncnngntnnaaancaaacanagggggggnnnaaaanggggggaanccggaaacccccncacgcngnanggcagngggnngangnacnggggaaaancccaccccccanaacncnaggacncncgtnggggcccacnanaacncancccgngggcgnangggaaaaanaananaannnnnagagggggggggcgcgacgcgaaannnncannnngcncgcgggccanccnnggggggaantccccgacacnccnnggggaaagaancancctcctgnanngnnnggacccatgnggcaaaccccacntgggtaanncgngcnaaccnctgatngggnngggcccaaataaaaaaccaancnagggnnggggcccaggaacccaganggtaaaacagcnncttaaaaaaaaattggaanncagggganttnggnntaanaaccaaaanagncnctaggaancncgggcgnacgggctnancccacncgnagaaaaggaanctcacgngggaacnanaagcgaatccccagaanaaaaaaacccnnccnngggcacccaaaacnnggccnggnctataaaaaangggggcccngggctaanaggaacaaanncanntcggggnnangggggnnnanaaccgaaaggaagaaagggcnggccccaaccnggganggggggnnaanancaggtagatcaaccnactngggggnaaaagggggncagggacctctangnnagggncccnanncggggggaagann

SEQ ID NO: 2131 - DNA, 779 bp, Homo sapiens
  misc_feature (1)...(779): n = A,T,C or G
gnantcnnnncaggatgcacgggcactttggaggaccnagcggccactctgagtaagatcatccaggtggcggtggaactgaaggattccatgggggacctctattccttctcagctctcatgaaagccctggaaatgccacagatcacaaggttagaaaagacgtggactgctctgcggcaccantacacccaaactgccattctctatgagaaacagctgaagcccttcagcaaactcctgcatgaaggcagagagtccacatgtgttcccccaaacaatgtatcagtcccctgctgatgccgcttgtgacgttaatggagcgccaggctgtgacttttgaaggaaccgacatgtgggaaaaaaacgaccagagcttgtgaaatcatgctgaaccatttggcaacagcgccgattcatggccgaggctgcaagacagctcccggatgaatgctgagaggancctggcaaggttttcaacccagatgaaganntgaattgaaatctgcaagactgaattttnaaatgcgattgctatggggcaagcaaaaggtgcacaagtcatcagacnggagagatnttgagnanattcaacccaggattttaactgcccnctcgcgtaaattnggaaccttcttcttgtaaancaggcagaacttttgantaacttctcccgagaaccctttaaaatattntnttcaaagtttcccccaaccttcaatntttgnggaaagcntactngnnntcgntnaaaatnncantnggccaaaanttccnnn

SEQ ID NO: 2132 - DNA, 826 bp, Homo sapiens
  misc_feature (1)...(826): n = A,T,C or G
nctaaacctttnaactccngncntttgcggannnnnngnnangaantnnnnncagattncactggaatatnnaaaaantttncttttaaactccctataggtcaangnttttngtttccatntatacggccataatcntccatagctnagntnatatgccattgttgnattanaagggancaaaancctanggaacaaagtagncttggcaagttggcagtttgtgccctctcagctgtttaacttatgtaatggatgtccgcacctgaaaacactataaaaatccagcggttgntnaaaaagnccatncgtcactaattccatncaggttctccaaccncttcttgaatatcattgccaccatttttactgttagaataaagaggcgacaccataaagccctgctgacaatgagagtnggntcaggacanctgtgattgaaatatggccgctatttacagtntttcaggggaaangtaanacncntccatgnnaantaaagagctnaagtgggtctacagttaaatgngacatngcagggacgannatantttttaaaacnacaatttcgntgctaaaaaagcctnctaggcccnngccaaattaatgcagtnanaaccnnggggttgccaaaangggaantatcaccccntnctttaaaaaaangcttaacccccccatattccantcttcatcanacccttgnntnccntctggtttaaaacgnnaanccaaaccctgggntggtnttgncnaacccaaacccccacccaaaaagaccgaccctgggtcctatngncaaanaaanccccctttttcatttggn

SEQ ID NO: 2133 - DNA, 868 bp, Homo sapiens
  misc_feature (1)...(868): n = A,T,C or G
antcngactcttnggaaaacttcncnnnttttaggaaaaaanccccccnaannnngggangnngggnncnaagaataangangtnggccggttttnnaacantancccnntnngnangggcttnnnttttntnggggnatattggnnaccnaangggcnggnngggaccnaaaantgggggnaananaaacnnaancnccggttttggccttncctggttcccttaannattncnggaatgggntancaaaatnggnnggaggcttntngnngttaacaaatggtaactttcaagagacttttagagggaaaaaaataatttaaaataactggcaaactggttcaannnnncccccnantttttcacgngcataaaccccttttaaaaaggnaaatttttacactattttggtngttaaaaagggaggcatttctactttccttngaggttttnggtggtggccaaacccttaaaaaacattttccccttttngggaaccatggaggttnataaggtttattaacttttttccttttaccatnggtttaccaccttttttaataaaaaaatccaggatttttttcaagnggggccttcttccccnggaatanttaaacaaggaaattgggttggnggtaaacctcaaaaggaaattnggcttttttaatangaacttgggattttcaaaatttctttaaaggnttcagcccttttncccttatcaaaatccacaaaattcatggtattngggaaaattaattaaaatggggcaaccccaaaaaaactgggggtttttnaaaaaaaaaaatttttttggggataatcaattgganggggctggggccacanttatattattnggggggg

SEQ ID NO: 2134 - DNA, 808 bp, Homo sapiens
  misc_feature (1)...(808): n = A,T,C or G
ngtctttttgcagggatnnnntnnnnannnngnnnnnnaggnattngaacaaccacctgtggnntttatanctnaccnccgatgangncatggtntttgattccttttagaggaagaanatttnaattttcagattcaaaggaagcacccttcctagtctatatatatagtaagcggagaactagttttacagtgctcatttcaggtcttcagtaagtgtgtatgatgatgtcagaagtattcattggctcactttcaaatcactgaaaattcagccatgctaaggtnggctattacgtgtattagcgtttccaagcgagtggtcttggctggggtgagattgtcagcctgnctgttaggattagtcacaacaaacatggtgcaaatggtttcaacaacagcgcacttcanggttaccttcataattcttttctgccagaacccaaaaaacaatactcttgagctactcagtgttccaattgttaaaaatttcctgaaattttcttcatgtattcaaagtgaaacataaagatctagnangatgggngngaaaagtatggacnttatantatcttagtgggcnttctcattgagcccaantgataaatttctgttttcccaagtnttttcangttgaaaaaaaaaaaaccnctcncaacnttagngnnggtntacttncgcnagnncccngncattgataaagacacnttggntnagtttngggcaaaacccccacctggnaatngccnctgananaaaangcttttttttgggaaaatcngnggatggctcntgctttaatnttncn

SEQ ID NO: 2135 - DNA, 1013 bp, Homo sapiens
  misc_feature (1)...(1013): n = A,T,C or G
ngnntcnnatcctttgcaagcccctgtgctctttntggcgagggatcccatcgattcgaattcgggcacgagggaacatnttncnaattnggctccttttttnnatttttccnngaatntggggggnaattttcctgggggcaaaatngggnntttttttttgganccccaaccctttgggcttatggagattggaatcctntcanggggggaaccaggggangccatttggnngataacggttcaatttggaccgcccacaagggantggaacttaccattgggaggggcttttaaacaaaggaactttcaacaatttacttggttttcttaanaggcccttaccaaaanggttaaacccccagcaacattggaaattttttggaggggttttttanttccacaaaaaggatggatngggncttggtcctggaatggaatcaccaaaaaataagaaaacaccnnnnaccgccaatttccattcaaaaaggggccaantnggatgaacctttgcaagatgccttggggccttaggaaaaaaccttccattccttaagcctttttaatctgggaccttaggtaatcntattggacccatttcaaatattttggnaaggccctttnaagtaaagggggggttggcaagaaaaccttcaatttccacaaacttggnccgnacccctttggggaaanaacctatttaaaaataatctttnantantcaaaaatntcaagggtanttggaaaaaaagctattttcttcntntnggatggttnggtcaagcaaaaaattcttacaattggcgaaccagaacaggtttcccnctggnggggatatggccaatcctttatggaacttttgcttgnggaacaatgaatcggatgttggaaaattggaatgtggcnttggnnntataatnggggttaaaangggaaagaatgggaagtnggnaantggctttantgnacaaaaaaatctaatngggcgnttnatgnangctggaataaatncn

SEQ ID NO: 2136 - DNA, 777 bp, Homo sapiens
  misc_feature (1)...(777): n = A,T,C or G
ngagtcnnnncgagacttggcaaatgttgctaacaacntcaagcagaatttgatgacggtggcaaaccttggtgtggtgtttggacccactctgctgaggcctcaggaagaaacagtagcagccatcatggacatcaaatttcagaacattgtcattgagatcctaatagaaaaccacgaaaagatatttaacaccgtgcccgatatgcctctcaccaatgcccagctgcacctgtctcggaagaagagcagtgactccaagcccccgttctgcagccgagaggcccctgacgctcttccacaccgttcagtcaacagagaaacaggaacaaaggaacagcatcatcaactncagtttggaatctgtctcatcaaatccaaacagcatccttaattccagcagcagcttacagcccaacatgaactncagtgacccagacctggctgtggtcaaacccacccggnccaactcacttccccccgaatccaagcccaactttcacccctntcgccatcttggcccatgttctnggcgccatccagccctatgcccacctcattcacgttcagcggactcatcccccgtcaggaacacccgtttcgggaanggcaaaaagccttgtntgcctgcaaagctngnacattgactccanaaactttccnttcacaggcangncncngnccttcgataatggttcacccaatcttaaggaaccttggctgggttggangggggactcttgaacnggaaagactggcctnaattccttgaaaatn

SEQ ID NO: 2137 - DNA, 928 bp, Homo sapiens
  misc_feature (1)...(928): n = A,T,C or G
gnagtcgnnnangcctangatnagtnacccaataattcttntacngnanaaactcctacatccagcnttttttttttaagnacccaacatccgaatancaaataaanggcgttccgnnnnttgcacaaagcaggctgggatttacaggcgtgaaccacctgcacccggnccanaactgcatctnaacagcnaagncanctttattcnnccccataactgacagactnngnnnccatccatctcctcaggttacagaggataanccgaanagaancgttacccgtagaacatatagcccacgtacttcnttnncccaanagatagggtccacnatcgcnnaagctgntctcaaactgctgggctcacgagatccncctgcccngcacttcccaaaatgctggganctacangngngagcccgcagtacccagccagtntntgnacnnccgaanatcgggagtnnctnancngcnannctttnctttccnancnggncaaanctnnaactaanaatnaatcccccttggnctanganaagccntntttactcccccccactcctntaaaaaatgnccccnccnntttcacgnaacanggncaacccaaacntgnttacncggnacaaaattgggctcccaccnttaaaantttcgnaggcatnancntgcnccantgnggaacctctccttancnaatngggaaaaacancnaggcccctngaaggnggcctcncttccannggggnannaagnttctggatcntggaaaaaanaaactcccaacaaatcgagattntaacngcnacnnaacccaaaaccaannggggnctatcannaaangaaggaantgcccccgcgatcncccccantnaaaanaanatggaacacccctgnttctctccaaacactntacaangaanagtccancg

SEQ ID NO: 2138 - DNA, 778 bp, Homo sapiens
  misc_feature (1)...(778): n = A,T,C or G
aantcnnnncagcccacacctgcctggccaacccctggcactgatgatgcctgggtgcgggttantttngnaggagctcctgcctgcctggatgaagaggaggtcaagactttgtcccccactccgcaagataccctctctgtnccggagcggtgggtccctcccctgttaggaccttgtctccctcangactggacctggatcctgggcctgcagtcagatngccagtttcacttagaggtggaaatgtcaacccactggttggaatgggaanctgctgtgttgngagccaccttatggaaaacccatgtggcncagaaccgannggtggtggctggccaacagcaagccaggagctgaggcccacaagtccaacaactggtgaggaaccacatgctgccancangccatgttagggaacttagaagcaaatccttnccccagttgagccntcagatgacaccnnaacccctcggctgacccctttacttttacccctttgtancnagancttntgagccaacaanacctcggcttaaaaccccccctgggnttcctnnacccncagaaaccttgaaannantaaacggngttgccntcaagtcaaaacaaaaaaaaaannnactcnaccctctanaaccatagcggagtcnanttacccacaccccgactttgatnagaaccatntnatgaannttggccaaacccccactttnatggcgtgcaaaaaaaangttcttttnggnaanctcggcaancctttgnctnntnttccnnn

SEQ ID NO: 2139 - DNA, 850 bp, Homo sapiens
  misc_feature (1)...(850): n = A,T,C or G
ntttaancccttgcaactccnngntctttttgcaggatcccnnnnnnnntanttcggcnncnggaaagattgtggccagatgtgctttngcttgctgtctagttgttgttttcagttttntagtgtggcntgcccaaagcttcgttcagcagatttaatataactggtattttaaggatgtttatctggtggtgttacagaagagagaggaaggtaggaagaccaattaggagagcccattgccatggtctacgctggaggggaaggtatgacctgtgagtctcaaagggcactcctggctggaanggaatgaggaataatgagagtagattgaccggggcttgctttcttcctactctttcagaatttcgagatgaattgctgaaggacttctcttactgaattctcctcaggggagtcttaattccangggtgagagtaccngaagacaaaaagagaaaacccnaaaccngaaatcttgcccttagcntggaagacgagggagaagaaagagaangaaaggctgtgtcangaagtccagagcacacctgaatgcanatcantntgctatgagaccangcccaaaagttcangcccagacaaatcccacaagaaccccaaggagattcccaccttggggcaccgggtggcntgggcgcctgttaatcccaancncttttggggaaggccnannaccgggtgggattcacccctgaggtccgggaagtttcgggacccagcctngcccaacattggccnagaccccttgttcttcttccttaaaaatncccaaaaatttcccttgggcattgntnccnaggtgccttttantccccacttnttngggaag

SEQ ID NO: 2140 - DNA, 986 bp, Homo sapiens
  misc_feature (1)...(986): n = A,T,C or G
gnatccccnnnnnnnnnncgnaattcgggnnacnnnggggggcctggcttaacaaaaaaaaaaaataaggaaaanattcccaagcctggggngggccgntnggggtccgccggcctccaatgggtgatgangtacccaagtccnggcctgggggaaggnaaggaacctcgcanccctggngtggnagggggattggggcctctggaggcccccanccgaagggggcccnatnggtcttncccncnngtnaccnntctntggnncgtacccacaanggcaaatccctaganccctntncccccttccccanatcncacntttnnntaccccataacnntcccccccttanacccccacanccctnnntcccnnccacnggnnnngcntnntcnccccctcctntccttcnttcnancatcccttnncgncccccnccttcnngcgacncnacatccntttcccccactccccnccctcccttccactnccccccncttccncncctcgtatccnacntnccccccccccttctnccnccctctgccctcgcccctntnntntccncccccccttccnccccccnnctctcctatnncttcccncccccccactctctcncncccgtcccctctntcccncanatctcccccatnctcgctttcctcccccntacntnncaatnccctttcctcttntgtcaannancncacncgctncctccaacctctnngcgcntnncnccccccacctagctctcatcntnctataccctctgnttttntacaantttccgcgggccccnnccnccgnaaaaggngcctctaaanncactaantnaaacncctcccattctcttnngcgggccacctcctcncactcatcccctcttctntntncnctatctactctcttctcttctcncncctatcnatcctcatctaccgcncctncactttcccntntntcaccactctcnacctcgcacn

SEQ ID NO: 2141 - DNA, 828 bp, Homo sapiens
  misc_feature (1)...(828): n = A,T,C or G
ncttngnccnagntcnnnncgagcnccnatgaggacnangatgagtntgaagcnaaggatgatgaacaggaanaagatgaaggcagaanggattcanatnctgagtcntcagatttgtttnctaatttgaatttaggaaggacctatgctagtggctatgctcactatgaggaacaagagaactaggggagctgctctggtggccgtgtgtgagangancaggagtgagttgtgtgtgcttgatgaattgtgtgtggttgttcaaaagtaccttaccacttagccttgtgcagaagactagttacacttaatgggccangcaataggntgtagcgtntttattagaactgataatcangcttatngcataagaaaaatgagtttcaaatttaagatgtttattgatccgaagcaatttgaagcctcatggattnggattgttncctgatttcagtaaagtattgttttgccaatttncatncatatnttccaagatnaaggggaaatagggatggnaaatannnttgttttgaaaattnaaattccctgnttttttattaaaaaaaatactggctttnatttgggcctgaatttntgtnaaaatgtaaatgnagctnaaaatggnantcacccngnttctttncccctttttncngtcccccccnaatgnggaatccctaactcntggttcntcccncctnaaantttccctttcnnattttccatgccccacccttnnagtttggccatgcatnnagncccggtctnaaacnccccnnccnantccctccccttncctncanaaatgnnccgttcnncnnncgntcn

SEQ ID NO: 2142 - DNA, 846 bp, Homo sapiens
  misc_feature (1)...(846): n = A,T,C or G
tgatcntttcaactcttgttctttttgcaggatccnnnnnnntcgacnncnncnccaggaggaactccccaggcattctgtgagatggtagtgttcacagcgctgacagatgtccctttgacacagtcctggggtcttctctgcacaacagaaaggagttttgtgacaaagttgatggaggaggttaggtatttaattaggactagccagggagggcagggactctgttaagcagtgaatttgtcaaaattttacttgtaccaggtgggaagataactagctgtggaagcctgttctgagatgccctgccatggccaatgactggttaaccacaagggtcactaaaagagagggtttctcatgatctgtagaaatgtacaactgacactattgtgtgctcctcacaataaggccggttcaggtacctagtttgtttattttattaatggggtgggtggtggtttatgaatcctttttttgtttttggaagcagttgctgcaagtcaagacttttttttttcttgaagttattcctaacatttgaccccaaacatgcatccccccatttggggcataccttttagcttacacccttgcttaccaccctggggtgtatttttaaaagaccaanaatttttattgattntattaaaaaaaaaaattntgcccaaccgaaaacccttttgtagcttgctttccttgttttganccanccttggnttttctnaaaatnccatnttttggganggggcntggtccantangggcanacatttttnttggttgcaaaaaccccttgaancccccttggtncctaanggggnccanaaaatttcccccaagntn

SEQ ID NO: 2143 - DNA, 853 bp, Homo sapiens
  misc_feature (1)...(853): n = A,T,C or G
ttgaaccctttgaaancccnnnnnttttgcnngannnnnnnnnnncgaattcnnnnncaggtcatgccttatttactccatttttaatcctgcatcccagatttatggcagcntttnatatctacaggatacttttatgttgtccaaatattgctgncagtcatatgtacttataaaatgtctccactcatgtatatttatagaaatgaaatgtcaaatttctcagactgttaaagtgcagtataaagttgcttaatgcacacttaaaaatgatatataatttctgaatcctatgaaatatgtgttcttttttaattctttgggagtttccttaagttttacatgttttttggcttattgttaatgattttgtttactctntgccaaattttgtcatgtaggttattttacaatagcacctttaaaaaaaatgtatatgctaatttactaagcatattcatgtccatttttattngatcatctgatntgtgaaataacttgaaatntgtactgtttggtttgtgaaaataatattaccaaaatccctgncattagaatgtgtactttatgttcagaaagtgacctgnggggtttatttcagaagccaagccattcctctcccttggatgcactttggtaacccagnctaccacatggccttttaaggngggctnttccctggatanggggtccaaggtnttattgacctantaaaaacaattttttcnntgggngaaagcctattnaaggtnncattaagtctaccccttattttccccccttggttnggaaactnaaanggggcgccagggtattaagccctaatncccccagcatttcccngggggggngg

SEQ ID NO: 2144 - DNA, 1146 bp, Homo sapiens
  misc_feature (1)...(1146): n = A,T,C or G
ttggttcncccaaaaggccaacccangnccaaggggccaaggtncaagggggggttggggnccccaaaanaaaccaaagnaacccggtctcggatcanccaattntttatattaaggttgggccgattttttntacccttgnaatcccccntaaaacaaaaaggcnggggggggattttnttttttttttnaaaaggacatnaaancnagngnccctncccnctcnatttatnggaaagggngaanntcaccttanccccactggngcntgggganaaaccatattttnnganaactctccnanngatntntccatnncanatntnatatnccaangnttccaannangtccttnaaagnaaaaaatggcntcatnntcgaccagnaattcanagaagtagtctcanaaatactanttanttctnagnaataannncnctcaacnatcnntacctacnncnttctntacnatatnnntccntancactttaantnctataccaaatcctcnactctaaacangacctnacnataactnntannacnaccacancctatttatattcncnctnnnagntaanacctanaatgnntnantnnntnctctnnnttnntnaaacncnanaaganaatctacncnccnncnctttcactangtcnactntatcnccactntacnaacnananatanncatnnnctnntccactcacncncannncatctcttgnaantacaacatntncatnatnattattaacnantactancnnnnnnaacancaatataangaannnccannctatnttctatcacccnctcntnntnctcncnntncttgtnnganactaantacgatnaannctnacanntatnaactnattcntattantnacnanactntccantcctnntnantnacctttacnactctntaanntcttcgctncnanctcananccnatatcattatntacnacncaaacnntactnatctatcaaanaaccnactaccctacttactncncnatnctaaccacctcttctcatccattctaccncaanctcnnanacancttcaanttattcnntcacatnntntcnnctctacnatntattnatnttatcctattttaatnnactntccg

SEQ ID NO: 2145 - DNA, 1294 bp, Homo sapiens
  misc_feature (1)...(1294): n = A,T,C or G
ncntnngtncatnaccnagtnngccgcnnnncnnncccccncccccccaacgggggcggggncnnnnncacntttgtacttcaatacgnctntgnnngaacnnnancancgggggtntntacaancatcccatcccnnccctcaccntcaccctaccnacangcactacnacgtncnncctnnatnnnanctctcactccttttnatntacgtcanncactcctacncncattncngcacacccacanncgcgancacactgacgttnncaantnnatgctnancganaacgtatacctcttcnnacaancatntncnntaacgtcacctntacgnctcttcncnatatncctntctcntanntnttnngntgcnnnccgcnatncacancanacgtcncnggntnntnatatctnnncataacnnatgttacactnatcacancgcnntacncgtctaccctnancctacttatcnctctatttnaccctctcaanctctacactcacacnntannctcacnactgctcctcnctcattcnnncccatncnccnctctactntagccattntcntctttccncgtnngnaagnncactactcgcntcanaccacatcccntcattactcaccccncatncnacccctcctncgctnactttacannanncnatgtannnagnactcacncanctccgctancatcatccntnnncncncatatcatctaccannatcatcctnatacnacnnaccnacattactcntnannctnntcgttntacancntnancnncctatnccgntctctcactcnacgnncganacagtctccganctnanacctncanactgccgctcnncatnannattctncnacnngncncnatctcgcaccncnatngntccccnattntaacgctcacacanncccacnnactnnancattntcnnncntnacnanttntncngctatctcacctancnacnacancacntattctcnnatgtcacanncncctcaactnanctacntcacgtctccacatnctcnacnctntccantcatanctcgcttccntctnttcttcangtnagacaccctcncancgntccnttncancacnnattntcnntctcnacnattcnctcgnctntttcccgnctntacccantttncttctcntttcatctnnnnaaccnnnnncncnntntnctntctacgnctatgnttnncntcnncaatctatttaaaantcnnnctcncccngntntantttntatntatnnngcg

SEQ ID NO: 2146 - DNA, 1371 bp, Homo sapiens
  misc_feature (1)...(1371): n = A,T,C or G
cncncannnnntcntnnncanngtttannngtatannnnntntntgatcncntnncnacctanctacacnngnctcncnnntncngnnctanntatatnatgtctcttntnnacntactcaatttnccnccccnncctntcccccnctnacttnnnnttttnaaggnttcgantccgcacggaaggaaatangcctcagnggaccccgnngcntatttatctnccanattgantggcagaatatttacaattgacagngatgatggggaacaggntgantncatgactgatggactntctgagcccatgcatggcagantnccccanntcaattntngttgnntccccacgntctncatcangnggtttggatccgtnnnggnggtctntgctngcnnttggaaactntnatcttcacaagtcgtntncnnncccgtcttntaactnncacnctcttannggatnctctannnncnnntgnctgatgatnnttannnnacctnnttannctacntnntnatnttnatntancantacnatnncantcgacacnncanncatgacntncccngcnntangtnctntnncttnagantagccgcnnagntcgtacacngaccnncnntgntcnnacgntacgagtcacnnnnacnnacantgtncntttncactcnantnnnngantctcncaatnnaaannnctctccttannntgactctntctatcgtcntaanctntttgnnacccccnctanagnctacnacncnctgtatctgtctgnnccntntgctttaggnnntctntcatctctgnctantcnaccgcnctcctcantngngtgnnnntccnactgntnagtgcgcatcgctnncttcncggaacgccacntanccgctgtgatatngtctaaantnntctcactacatntaaatctcttcacgcngccnctatgtnttcatntnctnacactgcccactcactcnctcnttncncacnnnncgtgntcggancnccatntctctnttnatttnnctcantcctacnctaaatgtctaacntangttctgcgnnccacnngngaatcccgctcnccgntanntnaattnntctagaggnagnatnactctatcttngntttatggnncngtaanctatggcnaacgcgtcacttnaactcncttacgtttttcntatctnacaacnatctcttcngcgtaaanctaaacnnatactntcnacnnatgntgcctccntcttctnnanattnaattgtnactcanctctttcatcatacgcttgtcnctangtcanatnnanacatttanntaggtaanngntacncnttatngacatctccacgccacaccncc

SEQ ID NO: 2147 - DNA, 1346 bp, Homo sapiens
  misc_feature (1)...(1346): n = A,T,C or G
ngtnnannnnnnntnnncntngttanganntnnnaatntnnnnnntatnnnttnnnntnannnntaannntnntnnngnnannctnntnnntnanatgtannntatnttnnntntaggngtctactntncnanncgtaanntnaannnnnntntnntannnnnnnatntanntnncgcgcnccccccacccnnntantatnnntcnncncaccctctccnnnccnntntncnnannnnnnnnnntcatanntntntttcgaaaatattcncgggggggggggggggttttattanttctanncnnaanaataaanagnccccccccncggnaaagtctaaagnatacttaagntngggtngaccgngnacccaagccttcggcacngntctntctatggaagnggtntcgctntttncntancctcgcgcggggggngcatttttcganagtcgaaactccatcatctnnnttctctnatgntttnncnnaatntaacctttcnatntatntacntacttttntgctnngnattntncntacactanagaatntctcactcctntgancnnnntaagntgtggnaaanntgaanaacattttanttccaattntctnatngctcnnnatncnngngttttcnnntnntnctatnnaccttctatnctttanctnntttttnatantcnttaanttntctactcnnantnagttgatgatctnacatnttncatattntataatctcnacncntnatttnctaatacnntnctctntntanacttnnatcatntctatatgacgttnccttctacngntcattactantatttcntnatcttgtcaatnnantntacaattaattntntcncttatattgacatctcncttnctcactgtatacnatctcacacntgattaaatcntatcttntatcntntanttatnncnatatctngtcctaaanctctantntatcnaantttccnatntatctaactagtnntnnnatcanttnatntatnnnnanntntcacnttntctcttcanncatactnagtntannatgtacanngtntcctnttctcaactttatatnctttnntntnnatgcncttntatanngntgatnctttcctttnaanaaatntanctttcttatattctgagtntcacatantacatntatatnatgtntnnntncntatctattcttatnancctnctaanantcatctatcatctttnntttntntccatnatactctatntattcttcntttaatcttcntatntntatatntntcatctannntangntctctatattnanntnttttnatnncc

SEQ ID NO: 2148 - DNA, 751 bp, Homo sapiens
  misc_feature (1)...(751): n = A,T,C or G
agnttcaattccgcacggnntncngccccttttgggncgcatttaattttggtagtgttaatgtctattaatgtgattttttttttaacctttctcccaataggtngatgacaacaagaaactaggagaatgggtaggcctttgtaaaattgacagagaggggaaaccccgtaaagtggttggttgcagttgtgtagtagttaaggtaagtcaccgtttattctagggatgaaggttatgctgggtaatcatataaaaccttgtattgaaataagttgaggatcttataaaaggaaaaaactgattcaacaggtttaaagcattttctgcatttcaggaaaaaaataaaagctgtaatttacaagccagccaatgaatctgcttacctgattgtgtttgtgcagacatactttaaaaactggcaatagtaaagccatgttaccagccttaaggacattgaagtccgtaaggtccctgagaatggctataacaaatcttagtgatgggaaacatttttataaaaacatagctaattgttgaagctcccctataattggatactaataancttggnngaaaattcctaaatanttaaccaagaaaattgcctgccgtnnttttgttttttttaaaggactatggcaagggantncttcaaggnccaaggatgtcattgaaagantattttcaaatgccnggaaatgnaanaaaataaaatctttggcntcccnaaaaaaaaaaaaaaaaaaat

SEQ ID NO: 2149 - DNA, 740 bp, Homo sapiens
  misc_feature (1)...(740): n = A,T,C or G
agnttcaatcgccgaggaggatatagcgatagagatggatatggtcgtgatcgtgactattcagatcatccaagtggaggttcctacagagattcatatgagagttatggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaagggctactaaaaggaaaaattgnggtactttttttaaattccctgttaagntcccctncattaatttttattgttcttggngagggaaaaaagtaaaacattgtttaatttttaaaaaaaaannnnnnnnnnnnnnnnnnnnnnnnanaaaaaaannnnnnaaaaaaccngggggtcnttaaaaatattgggggggnnntttttccnnnctccccncttnttaaaaaaccttttggggngggtc

SEQ ID NO: 2150 - DNA, 745 bp, Homo sapiens
  misc_feature (1)...(745): n = A,T,C or G
acgtttcaatcgnacgagatttttatgtgtttattcttantttatagaattcttagttgctggaagccctcaaaacttagtcatattaccattgggtatttattgngtccctttcaagtgagggacgagcataatcaaatctgcattgtacatgaccaggatttttttttaaaaaaacagtactgccctggtggatctagtttattattgagtgtatagcagaaaggtaaattgtttgccatgttggtgcagtttcattgggagggaagtgttaactcccctgagcactgcccttttctctctccttaattttacagtaggttgcaccaaaaccattcctctcagagaaagcaacactccagtatcttgtttccattaagagataattagctttcagcaaatcttcctcagcaaacaaattacattttaacttctttgagttcttttggagcaaaatttanctgttttcctgtattgcaaaaaaaaaaattgtttatgttctggatctaanaattgntgntattttagnttgcttggtaaagctatttggtttatgacaagattcataaaagtgctgtccccacagngaaattttaggggatntcttaaatgaagttcaccagnggaattaaagggtattagnggttgaagtgaaaaagtactttntgggccataccaggtcccctgncttcaagttggacttcttctaaataagttttggggccatttggccattctttcaata

SEQ ID NO: 2151 - DNA, 1336 bp, Homo sapiens
  misc_feature (1)...(1336): n = A,T,C or G
ccatanncntcnaaaaatnatanacnacnntnctanctaaanannnctanatannccatatctcnnactcanannccnncntnatnanatntcnnntncncnnannncctntacnntannaatatnnccccncacnctnnatcnccnnctccatttncntnnnnttaancntngnaacacnatggtggccnntacaaaangcattcccnctatactacagtgtaaacctcatttttttcactccaaattgtagcagcccctcttcttcccacnnnggggctttttcntacnncctnnacncnnancacacagnacctanaanngattnnatacannnctatanatcacttnncanactcangttccgaacanaaanctnncncgnactatcncaccaccaatactcactatangaaaaaaaattnntcnccntntccccctangnannnactccantatcattnnnacnataanannnaaatcntactcgtccnannanatgatnancaacctccncatanatntnatnnntcttaatccacctctnantacggcnantcacnattnncancaannnangnatatancatnnaactactntctcncnactnntatntcctcccncnnaacnnctancntctantnaacacnctcaagcactnnntancaacttcaatanctnannnacnatncanttcgcgncttanactcntntaaatnntacacaccagctatgcnaccacaanccagtttanctctnagtatcgaaacatacntngatatnaatcatattaacataatntacgnacanaacaccncantnattnnnctncctaccaacatacgacnnntatatnctacgcacngcatangncntcctcncagcacctatcnacnctnctncaacaatacnnnnancctgactanacatactancgtacatncctcantntacttntctganataccantcgaagtgnantnatccacaagcntgcatatcnacgcnctanatactgnactcaanctatacatccgcacncnatacacatactctgacccaangntancancacatanncanctnaaccnacnannacgnnatntatcnatntnncctcntnntnacgtaatnaacngacgcananntaacaaccctatcatacnanaatcnaaggctnncatatccatacgcnacnatacctctcntacnctcatgtagangtcnacncnacnnaacnnntcacgaantctaaaacnatccncaagnaatacgtaacacgangnactcnntngactanntataacngcncncacangnaattntaaatncncn

SEQ ID NO: 2152 - DNA, 875 bp, Homo sapiens
  misc_feature (1)...(875): n = A,T,C or G
ccccnnncannnnngnnntncgnntcnncnnnnnnttcnnnncnncncnnngtcnnnntnacncntcntnntcnctcanctnntnntnnnanatcccccccncncantcccnctcccccnnnnnnnnncanattttcgaatcngcgngaacnttctcgactgcccngaanatngcanaccattatagggactagtttgcctttggaggaaaaggaaaattgcaaacccttnnggggagaccnatttgcctttggaggagaaagccaatttatcatccaaaatcctcagaattctcaaatacaaaaagttctgaaaactgaaagtttcttcttaagtttggtggcaaaagttatttatagtcttgacttatcccatttgatgtgaatctgcttacatttcattgcacaaaatgtttctgtgattgtgaaatactgttccagaagccactgggaggtttaacttaataaatagtatatgcaacgttttactcttctaaaatctgaaaattgtgaattctgaaacatatctcagagggtttcattaagaatttttgggcttatacaaatttatgctacataaatgtttatagtcttgtctttctctggtatatacgttcttactttgccattttacttttaggccctcaaatcatgccaagttatattttaagattttgtttttggcatttcaaaataactatggttactactatgatagtnttagggatggngaatagggtaaatcctngctttcaattttttattttggtattcaagaatatggttactgccccaatttattttggaagtttttcctcaaagcgtaaaaagttttngctttcangcccaggctgggtgggctcancncctcttann

SEQ ID NO: 2153 - DNA, 842 bp, Homo sapiens
  misc_feature (1)...(842): n = A,T,C or G
aagntnaatccgcacgagactaactgggggattttattcnnnnngcccaccagcacnatcgccagcttgctcccaggattgncgtcgtgatcatttggacctgngatgnggcctttntcaatacgtggtcccctannttgttgcacaagttcaacgangtggtgtggcatgtgagctggtccatcacagccaacatnctggctgtctctggtggagacaataangtgaccctgtggaangagtcagttgatgggcagtgngtgagcnatcagagatgtnaacaaaggccanggctcccgtatcagcatnagtgaccagacggcccaccngaacnaagcnattganaatacangtngngcctgantncccncccgtcantccaagactgnccctttcntgggccaacttancncaaacanntggggaanaanccccancctncaacngggatttattttnccangtaagagtttacttttgctngccnccaatttgattcattctgnnctttancgcngatncgganaatggnttctncaaatctnacctgtcccaggctgtaaaagcacttccatgcttacccatggaaaanaaacntaacaaagtnaatggtttnaaaannntnatatttngagnncnanttatttannnaaccntttgggcttctcacgnccattanatttcnggggngggctntttngnntccccaaagggaancttntannaaaacggtccttanttntttntcttnnnannaatttantnnatnnctcntntactnttaactacnaaacnntctnttccgactacctataataaacttcttgtgggaggcngcttcg

SEQ ID NO: 2154 - DNA, 1236 bp, Homo sapiens
  misc_feature (1)...(1236): n = A,T,C or G
tnnttnnnnnnnnnnnnnnctttncnntnttnnnttncnnnnnnttnntnntcnnttcntnnncnnncnttcntttcntnntnnnntnttcttnntnntgctttncnnttnnnncnnntnttgtnnttcntnnnntnnntttcntttncnttnnctntnnccnntctnctnnnnntncgccccnccctctccntncnnnncccccccctcntctntnntntntnttnttttnacgcctgacnngttngaaatgggnnttttttttnttcttncgccccccntgnactncntcccatttttcctttttgccgacccctcttttttttggntngtntctnncctnntcnggggnntttttttcttttcctnttcncctctttntctctcctttttnttccttntntttntttccnccnntcntttttccttcctctctttctcttttctctttctttttnctnncttnttnntctttnctcntccctnttttccnnttctttttcccttcttctnccttcttctttnctttcntctccctctctccctntntctcntttntntncttcnnnnttttnttctttntcctctttctntcttcctnttttcttctttttnttcttcctcnctttntcntntcttcttctctctttctctttcctctttccntcntnctttcctctttcttttttgtnntctncntcnctttnttttcnccttntctntttctannttttctntctcntcttctncttncnnnntttntntcttttcctntctnttctccnctttcnntctctntctcctccttttntnntctctctcntctctctctncncctntnctctcntctntctctnncntnnttnttnctctnctctnttttccntctnttntcttctnntctctcntcttttttcnnttctcctcttntttctncnttctctnctntccttcnctctctcnngtctctntcttcttcctcnttcnttcctnnttttntctcntnttctcttctccttctcactttccctntncttttcccctncctctcnccnttntctctcnctctccctctnntttnncctnnntcntctctctcntcttcttctttntntnttctcttcttcntnctctnctntctcnttntccttctcttncctcntcctcnctctctttctntccctctcttnntnnnttcnccccnctttntctccntcttctnccctctgcntnncg

SEQ ID NO: 2155 - DNA, 1378 bp, Homo sapiens
  misc_feature (1)...(1378): n = A,T,C or G
tcctgtttactannntcatcatnncttnattnttcnccnnntttgtctcnnnctnntcnnntnangngtctnntcntctgggantcanntcacnncttcntctntnnctattgttncccccccctcctannncccccntctnnatattntntntaaantgnacgagtagggccgnntatnntnctntgantgaccccngctgtgtttgtaacctgnntatnctgntactctcnattttgcntgggnntctctttantcactnancgggggggntttncntatnantacntctngtcntcttcacnctttcttctnctnctntatcnnanatncttgcttnattacntnccccttcttatcctgggataatngacncttctcactttgcctcnttnnttnncctcatctcaagnaaaannntnngcntcccnnnatcntgcctcttgtcgagctncactacnngnnnctnctntancnatattnnagtntacnnnantcttatacantccactantantcccnccttannacgctntcnttancttcnnctgnacnattnatttanntctnacnattaacctantanngtagtncncttntatttactactgngccntagcncctgantgtctatcttacantttccgacnntnnnantctctncnttccnatgnncttctnttccnncncananttttncctcattcncnncatctnctnantnnctcttncgnngctattgtatatccgctttcnngatattgcactgtactctantctcactatccttntctcttacgtctcantactcctacntatntatcncgantctttntcnctacantcctctcntatncgtaatntactagtcncttagttnctnnacaanngngctctctcctcttccntnctcgctcctctattcnnctcantanntatncgtctcactctcttcttctccacacntcctccatattccgacgcgtctntnnnncttacnntagnctantctngtcccctanttgtactcactntctctcncantctaaactctttatcgcgtntttctctcactatctctcnacattatactctcatggatctctcccntccnnactatcngtttgccgnacnnngtcgagtantntntacttatnacgctcatacangatatatgtatattgtcgctcctntcttcttantcntanagnatccatntnaccatcttgctcnnattntcacttactctnctntcatnatctatntcatctgtntctactcgnctcatataccttcttcnnatgctctcatttacccnatctctctatgcgnctctncttcacngnatctatttcccctgttntntttcnntttcncc

SEQ ID NO: 2156 - DNA, 1333 bp, Homo sapiens
  misc_feature (1)...(1333): n = A,T,C or G
ggcccaatttgggtttaacccaactcccccctcggggaangtccccccctttggncccaaggtttgggccctttggccgggggnncaggacccaaattccccnangncctttgnnccnaggagcgctttaaccgttntnnncnattctcgggtatttatttctctctcggnnccctttctnggcgntnggggggggggggggtttnttttngtatatacacctctcngagggngngaaaatacatncaccnncntntgnggnaaatttacngtcananacngccanaccatatactcccnnananatactttnnntnntcncaaanncngtacnnctttctctctannanttcgaatagnnnnacantcctntattttnntattttaacttntacaantgcnnnnantttanccctttttactgtaccaaaaanaaaaancntnttngccntttatngaggnntttntacaaaanattctttctntcnccaatttnnctnnccaaaantnnccctatcnntctaaaatnacnnnaaaaaantttcncnatcctcaaataanacanacnctatatttttnnaatgngnattcanaaanttgggcccnccatnaaaaaaaaaaancccccctttctnntncaanattganantttggcgngagaatttntnaanncctccccccnntanaaaantttgtnccctnanataanatntcatnananaatataaaaatattntcnaccnnatannttntctnacctcctcctcanctnactacatatcaancatccacttctntatatgngnactncctnactaatnnntantatttcactacnctcncctntacaatanttttagnatngtcatatcaatccctatncnctanttcttttcnattntacntctatnnncntancatcaacnaatnttcttnctagtatanatctacncnctntactcatcatncactatcatgctcttaatntntctctgcntacnnatnattacttacatattgncctntatttntnntntacttctnattntctcactcctccttctacntttanatatcatctctntcnnntacncgatntcctatatcacacgnntaaaatcaacnnaaatncncantcgctcttcntcancnccctcaancctnacnnttcntntcactgttntaactccaattctttnttaactctncatcattctctacntcnncnntattancacatntatncactctatctatttcntctacttacnactctntatcantnttnaatccnatttcttacctttatnaaatttcncnaatcttcncncc

SEQ ID NO: 2157 - DNA, 700 bp, Homo sapiens
  misc_feature (1)...(700): n = A,T,C or G
gccttttcgattccgcacgaggtgtggagtgtcccaagnnccncngnnnnnnanntnnnnnctaatnnacnnctngcagtgaaagtgggggcagactgagcctgtgtagtgaagtgtcttgaggaacgtcagctgtatcttttaggaaaccaaaactgcatagacattgaacccaggcagaaggtcatgaagtcagagctaagaaatgctagtggggatagggggtgagatagagttgggaaatgtttcagagctcaggtgacagttgttggtgtccagttggatatgtaccatgaagggaagaagcagtcagagtggcaccaagctttctagcctggaggactgaatggttctgtgcacatttcanatggaaagaatagaggcccacagaaagttaatgagatgcattttatacataccagttttgaattttaangacctgtggggtagatatccaagatggctattcccagnaattgnatttatatcttgctacatcgcaaaaangatttgaactcttacncncntaagatataagattaaatngctggacgtggtactcaccctgtatcccacattttggaggccagccggtggatacttgagncaggagttcagacaanctggccacatggtaaaacccatcctctaaacttcaaaantaccangggnggngggccggcctgtaanccactnttca

SEQ ID NO: 2158 - DNA, 970 bp, Homo sapiens
  misc_feature (1)...(970): n = A,T,C or G
cncnntannnnnnnnnnnnnnnacntcnnntnnnnnnnnnannnnntnnnnnnnnnnnnnncnnnncnnnnnnnnannnntnnnnnnnnnnnnnnnnntagtncnnatnnntnnnntnnnnnncnnnnnnnntnnnnnnnnnacccnncccnnnnnnnnntccccactccnntctnnnnnnnnaaataggnnnntnntanntnttntnttnntnnntatnnannnnnccccctttnnngttgacctgcaggcatgcaagcttgagttttntatagtgtcacctaaatagcttggcggggngtcatggtcatagctgnttcctgtgngaaatnggtatccgctcacaattccacacaacatacgagccggaagcataaagtgtaaagcctggggtgcctaatgagtgagctaactcacattaattgcgttgcgctcactgcccgctttccagtcgggaaacctgtcngtgccagctgcattaatgaatcggccaacgccgccggggagaggcggttttgcgtattgggcgctcttccgcttcctcgctcactgactcgcttgcgctcggtcgttcggctgcggcgagcggtatcagcttactcaaaggcggtaatacggttatncacagaatcagggggattaaccgcaggaaaagaacatgtgagcaaaaaggccagcaaaaggccaggaaccgtaaaaaggccgcgttgctggccgttttttccataggctcccgcccccttggcgaggcattnanaaaaaattcgacgcttcaaagtnatgaaggtgggcgaaaaccccgccnngacttttaanagnatacccaagcgttttccccttggnaagcttcctttgnggccccttttcttggtttccgnacccctggcnnntttacccgggantaccctggncccgcctttttttcccnttnnggggaaagcgngggggctttttcataagcttcancnct

SEQ ID NO: 2159 - DNA, 786 bp, Homo sapiens
  misc_feature (1)...(786): n = A,T,C or G
cnncccctngaattcggcacgaggaaccctgactctgcctcttagcccctgggttgaagccgactagagaatctcagacgtgcttaaccggtctgttgggcttccctgcccttttccagtcccaggtttcctttccctgctcccttcctgcttctaatttcagccaaagagaaagcaaagatttagaaaagaagggtaggaagaagctggaatntgaattggcaagagaagtnngaggttgtcttttctagatcaaaacaatttttaataggctgatgttcacatgttgcactttctaaagcccgtgcttgacctcctaaggaattttaagtcctattctgataatcgatttatgaagtaaattgccattaacgcctctgttttatagattaagaagaaaatgaggtcacagataaatatccgtgccnaaacgacgtggtctttgaactgacctccaggcacgatgtcattatttaactcgagaaatcacagcttctgcgtcctaccattctgccaatattcacaggccaagaagctcaacttaacacccctnggtagaaaaaaagaagaancccnttaaatatttgcttggaataccgggaaaggagaaaggggaaataattnggaacntaacctntgnctnngggaggggggaaaaancanatnntgggaananatcccacatcgcaccccctgntatggaaagccnttttgaacacanantngaantgggaggngctttnttngggaaaaacccctntcccanantttttttggaaaancnat

SEQ ID NO: 2160 - DNA, 754 bp, Homo sapiens
  misc_feature (1)...(754): n = A,T,C or G
cnntnccttcgtgcccaaggcgcccggactcggctggtcctggagagggtgcacttcgagaagtacaaccagcgctttggcaacgatgggctgcatgagccgctggactgggcgcaggaggaaggaaaggtcgcagccttcaaggaggagcacatctaccccaccatcatcggcaccgagcgggacgaacgctccatggcccagtggctgagcaccttgcccatccacaacttcagtgccaccgctctcacggcaggtggcacgggcgccaaggtgcccagtcccctggaaggcagtgaaggggacggagacactgactgaggcgatgggagctgcccaccagagtgcctctgagcagctcacagtgtgtgcccagatgtgccacccctgtgggcagcaanaagctgggatcnctgcagccatgttttcccggncatgccggcgttgtaacctcaggacctttccttgtangaacagcctttctcgaatctgntttcagctcttgcattncatanatgaaaccncagcatgtnaaagaactatttttttaaanaagtgatttttcttattanaccnantccaaatttttaaaaaaaaaaaaaaaaaaaaaaaccncganctcntncnnnnttttccngngccccntttactntccntcccnaaaacctnatanaaaaacntttttgtnnatgntggcnanaaccccccnntcttaantnnncnnntccncnnncnccccncctcctnccccnna

SEQ ID NO: 2161 - DNA, 1109 bp, Homo sapiens
  misc_feature (1)...(1109): n = A,T,C or G
tgngnnnngnnnggnccgntgggaaggtntcnacgncacanngannaancncngantcngtananattntgtatnagncctttgaagtatnttggggttnnacngggnancgtttagttcgngatgacnatgnnnaatttntatagangattatgggagcnnngccgatgtannntatatgnttgtcacatttatcntattcctcnatngtcatattaatatnnnttnancgngcgatanganngtgggggggtgcgncatnnntagannanttgntcatggaatagnatncgtannttttaancnaatccnngttnatnatntgancacggnccntatnaggacgnattgannnntnnngagntantaanantgnnnacncggnntnnagaggtngnctcnnaancntnnttntcantgngaagtncnncnnncntannnnataatgngtcntagnnncaantnnanntngtgannantgtgtgatgnannnngntatatnnanngntngnntnttaagtnnnnnggannnggncngngncnnnngtnnnnnnntngnntannanncngcgttntatgcnattgngtntcanctcagtctntcngtcangnnnnngcncgannnngtantancntgnttaganntnganangnntncgntngggagtncnntgngggactnncacnacnnnnngattntcgcngatgancgcctctgatatnnncggnncntnatncatgcncgtntntgacctanannagntcaacncntgnatcntnactnnnttnancnnnntgttannncgannnggnntgtncnnactnnntntgacnnntcacncggtgttancntgnagancacanacgantgcnctntgtctannngnntganaaccgatgtgttgcacgnaatntatctgtanatttcncntgnngngcatagnnnagngnaaatngangcacgnannntggcataantnatcanannantcgtnattaattgagtntatacggantnatannnnntgtcnggattatacgatatangnacntgtncannatganantatgaatcnanatgnacattaaggatngggatntanacgaag

SEQ ID NO: 2162 - DNA, 978 bp, Homo sapiens
  misc_feature (1)...(978): n = A,T,C or G
ggggggggancgtaatntcgnctcntntgnattntaagaattngtactattgngngnnnngtattntgcacntgagattaatncagacgatcgctntagtagcctatgacagctctgcccggtacattttatgtctatcncccttagtgggcgnggctcatgnattanntnncacgggattcnacttgatgtgagntgttgcncanntnttnattttntgagntcangcagnangnntagcnnagtttannannntgtaagantgcngcnttnaagtantnnangggcgtccagtgntngtgaaagnnggtagnanatanccnnnggaacggnttttngannnanangcnganccgcngnttgaanaggannnatgngcgaggnttanggtgnantngnnanntnanncannatnntntgtgggcnanntntnnnnattcngnntgcccnngntnnancggatanccgngnnnggnccnnggatnattnngnntnanattgangngantgangcnangntnnnnntngtcnnncgccctntnatcgtgtgtacgngncnnctgtngtntancatgtgnnnncatagnaacnanantcgntatgngnanntgtntatggaaattnagatgnatatggtttntannggaggttgtnnnnancagcgntnnanctnnnnnggntantntcaancgntagnaacntngtgtgcntnangaggngntnnaagnatngtgcaggaagntggggctnnnnttacctnaatntnngnagntctgnnncatagtnacncnntgaaccnncctaggnaannngnctnnnnccngnancngttnnngtnttangcaccnttnnagaangctnaannccggnngnnngntgaattagncgnttgagnggnggngntcgantaaantgggnntgatnataatattatcnangcncnannatgtgncgtatggngcaaattcaggcnnntan

SEQ ID NO: 2163 - DNA, 778 bp, Homo sapiens
  misc_feature (1)...(778): n = A,T,C or G
gcccnctcgaatttncacgacggacngccagcccaccatgtgtttagatgggatantatggtatttttcatgtgtcattgcctggcatggtntatattcgactacattcactcaggggtgtcccagggtggcacactgtgtntttcaaaacttgannatgcagtccgcctggttcatccgcgaanccatgacaatatacatttttttgtctgcnttangggacccaactatnanctggagaactggncgctacagattacgctgcgggggtacancagacgaaatcctacatgtataactacagctctgtgactgtatntaaagganaanagagnnntnttataaantatgtntanataaatgctttcaaaaantctaccttctgcagtttttatcacatgtatgtctnggtnnctgccctttaatcattntngcatggcccttgccnctgtgaaaaaaaaaaanncatcngtagtctttggccaaantgatncaatttnntttttgtggaanntngnaganntcancntagaattgctttttanggancctggncccggttnantcntnngntggctntattttttttaaaacaanatgaantcaatcttttctctcagnccgcttntntcaananaacttttgnncccggcattnnntcantanaannaaanntccnttnctttgctcacgcaaccnttttttaaaaccntttaaccggnnnggcagcacncntctggttttctaanntttcannaanantcctcncanncggana

SEQ ID NO: 2164 - DNA, 1165 bp, Homo sapiens
  misc_feature (1)...(1165): n = A,T,C or G
ggggcntggntaannngancncgcaggtngggcgngactntganntncattannttacannncggntaatnagtntgcanntaaaanttncnnnttgnttntggnnnttttcntaaatanataacatttgcgnntgagnncngttccntcaattgcccngntggcgggnnngacgnnannccttnnnnanggcnangngacntgcngnttgtncnnnagntnacttgnnatnnaatcncttgncngccnnangtnngtanntnggngaaaanntcgntntnntnccnccnnttncnacgnnagtgnagtangatnggctnaatttntcttaagnntattgannganncagtnntncgnctaatnntcngcnaatcgngtncagtgnatnagtcgagnnngtatctcgcttngtnantangtncnnagtgtgtgtangtcnacgcggctgtgganttgtattangagtaannnacgcgncgantgatnagnnattgctatngngntantnnttcagcggacnttnatnntgcgaggcgtgttatacantgatgaggntagatanctntctccgtntgataatntgancgagagtaagngccnngngtanagangnnncntnananagangtgagtatntcagaagncgngtatttncgatananngtagcgacntnccgcnngnatgtctanngnctnggacnagctgnnnatnatatgncagatgnaancctnatntgtncntnaacangnanacacgagatatatctngantanncgntgtatntatatatgtgnttncnagattgtnnagacganatgatcntatantatgnngaatgtggcngtatagangcgttaaacnnagncgnagttntnngntaannnaactantcntngncaacgcaatatgtggcnaaatgatnctccatcttanagcngcgcgnggattnatattnnttaanaacgatcgttgtgtntccacngangaagtnnaatgatntnctannncangtatatgaancggagnaagttnnatgatcnnnaatantngtgtnntanatcgnatgtatatagtgcnacgnantnctngcnngaantaganctnntnttntgntacncacaatntcntnancctgcnnnngantattacgtcnntntngtgan

SEQ ID NO: 2165 - DNA, 1271 bp, Homo sapiens
  misc_feature (1)...(1271): n = A,T,C or G
nnnncnnnncaccccaccactgnccgnaaaactatgganannaaaannnntgggcnanngntcntgaaaaagggngatgtatggatttanatccncattggcgtctcaaaanangangggangactaggaggggggtgaattanntntgtcatanncgaggngntntnaatannatnannatgcccgattntatctnaaactgtannctccnatccnatntattngcatgcnacagtaacgtacnccatctntacnnactatctaatctnctcgngngggggnggtgctnttntntatgcaattntaaacaccgcganttntcntataancgcatcgatatactgnctcgtcacacncgtancgccnctgatagttatttgatcngcnatnccncccttnttgnnncnaatcnnaccgatacgntaccnctnataacnntnnnnntgctgnantatntcccnntatcncttcannnaangnacnccntgtnntncatnncnttcngcttcnnncaantnanctgntctagctnagtnaacnnaananccnttcncnatntngnntcnntntntgtcnntantnannntaaatnnnccaancancngnnnaanttcatattnnnccncnngcacacgnagtaatgcgtcantntannnctcgnnnnnatntannatctacnntctttatcgncnntntgnactgnnnatncnaatnnncgccaanncatncanntggntgtancnnnnnatnnacannngnnttnanntccncnatcnntnnncgacnnngaatcatannnngcnactgtaagnantantacgctgtgnnatnannttgcgncatctgacncgantantncgacntanatatcatntntnattnatntacncgcatancntgnnatnatntantnncnnattcaaaangtanatgcgnctatatnnccnccntnngatacatnntcngacntnngtaagatatcggngantanatgntgntccctactngggtnanactagcnctntncaagtngatcgntntntgtngtgtaagacntgncgtcttntgtatacgaanngatacgccgtnccccnanatatangntncnntnngacgatantacatcctcaanagtatgactctnncgcantgaatagttatanatanatatntcanatggatnggagttattannatgtactctacttatnctccgactattatgtacaccgtnatgtacnancgatactaccntataatntacgcgntg

SEQ ID NO: 2166 - DNA, 740 bp, Homo sapiens
  misc_feature (1)...(740): n = A,T,C or G
cctttnttaaaaaacnagccacaaaatccncccntggatctagtctggatctggacttgaagggaaacatttttcttatcttttgctataagggacattagtgggacacttggcaaaatttaaattaactgtagattagataatactattgtattgttaattttctggcttttattctactttgattatattataaaagtccttgttgttaggaaatagacactaattattttgggttaaaggaatatcatgtgaaattcactttcaaacagttccaaaaaacacagtgatatatatgtatatatatgggtgtatacacacacacacacacacacacacacacagagaaagcagtgtaataaaagttaagatcatttgggaaatctgggaattcttttacaatcttaggaactattctctaatgaaattatttaaatatgaaatgttacngtatttaatatgaaaaaagagngagctcgctgtatgtattctctcatgcaaaagtatcggccatattattgccaaggncaaaagcaagtttttgaaagtaggatgtatanctctgtccccattttttgtgaaaaaatgggatgtatgaaatgcatgtgcataanaaaccaatctgttggcccnggggcngaaggcnccncccctgtaattncnacncttaagggaaggctgaacccagccgganccancaaggntcaggnnaantgaaaaccttncnngnttaaanaagg

SEQ ID NO: 2167 - DNA, 718 bp, Homo sapiens
  misc_feature (1)...(718): n = A,T,C or G
cctntnatcgccaagtgactgtgctccctgaccgcaacaaaccgacctcacactgatgggaactggacatgtggaagagctgctggctgcatcagggaacaggaggaggaagagggtcagggtggagaggaagatcagtcagtgggcacaagacagtcaaatgggcaaggcctgcctcggggaactagaaccttccaggatctggagcccgggagagccacactgtgggcttaatgtgaatagaggaacaagtgggtatctctgccaggcaccccactttcttctagtaacatgggctcaggggactcagccctggacagagagcctccagagagtgaacagtcttccagatctgggccaatcatcctggacagaggcccgcgaggcagctttgccctgtccacctgttgggtgggcagagccaccaggaacccagacaccacctccaactctgagccttccagagcttcagcctctcttcgtcgtcttaccccactgaaaccaacaggggatcgggccaggctcccagattcttgaggacagggacttcngcatttactaattggggggactactgtggnggtaagggggcgcctgcttgcctgatncangatggggtnnagggacaagtgggccggtcctcactcacggantgggggggtgtangctggcccaccccccaaggcttgtncancnantnttcttccccgcagggcca

SEQ ID NO: 2168 - DNA, 739 bp, Homo sapiens
  misc_feature (1)...(739): n = A,T,C or G
ccntcnttcgaattcgcacgaaggcaccccctcccggggtgntggttcctccttgtcacctgcctcctcatcatggaagggggtgggctatgaaagccggtctcaaagataactgcatccttcattccaggaaagccctagaattagggcacattgcaaactgaaatatgactataattcttatgggaccaaatttaagcaatttttgtttttggctgaagagacaccaaaatattagaggacaaatatttttagatccatttaaggagttttgaagtgcctaagatgacctatttgtcagtggtgcaaaattaattctcttcttttttgagttgtagtgaatatgcaatttctgtgttccccttccaccctttaaatcttaggatgacaagttataaagaaagaagatctttgtctgggacccccaaagggatcctttctctaaggtctctgacagtgggtccaggaccagacctctctacaaaaaattgccccaactacagtttgcaaccccaaaccacattagaagtctgtgcagacatccctccgtggtgtgtgtcttggngcattggaaaaggagtcaggagcccactgtgangtgagaatgaaaagtggatctcaacttgggcacngggggctcacgcctgtnaatcctaacaccttggggggtcaaaggtgggtgggatcacttgaggncaaggagtttgangccagcctggncaacattggcnaaacccct

SEQ ID NO: 2169 - DNA, 732 bp, Homo sapiens
  misc_feature (1)...(732): n = A,T,C or G
nctcacccatttttnacaggattttatttcggtgcatgcattctgctccaagtgtcacaattctggntacaataattataatatttggagttactactaagactttcctgaaagaggtgtattgtcccaaattttgtaacataaaaaaatactaaatgatcttaaagcttcctaaattgtgaaaagggtatgtgctaacatctcagaactttanacctgcttgttgtcatctttaccgatctctgatgataaatgcagaagggatctgagagtttttaaagcaagtagagtcaatcagagttttgaacatcatagtaatacttccgtgattcagagttagatcatataaatcaaagtaacaatttggattttttttaaacaacaatatcataactgtcataaaacagatggtccaaccccaggagcagataataacttgggcagctctgnggggaacaagacggggaaaacaactgttctaactgcccactagaacagtggtttnaactactacaattctcagtgtttganaggtcaagggaagaaangactatgtggatcccttgtggctatgcagatactacctcaccagagttgtcggtagaanactggtggtttggttcaaaccttgtgantaaaagagttggccaaccttttantcttttggaataaaagccaccntttctnanccaaaaaaaaaaaaaaaanctcccccccttaaaaattattcna

SEQ ID NO: 2170 - DNA, 803 bp, Homo sapiens
  misc_feature (1)...(803): n = A,T,C or G
cccccntcgattcngccgagtggccaagggtggggccaagactccacatagatccangggctcattccatgatgctctcatttcctanagtcctccaggtgtacagggaattgtttcactgacagacaggccaggatatctcataagcttcttgggcacaagttggagtggtatgggtggaattccagcacaattaggcatatccgtggttgggtgaacacaaccatacaagggggagaggtctctaccagtggcctgtgcagncctgccatgttctttcctggtcaatgttttaaatgataacttgnaatactactaaatacagccgggccgcagtggctcacgcctgtaatcccagcactttgggaggctgaggtgggtggatcacttgaggtcaggagttcaagaccagcctggccaacatagngaaaccccatctctactaaaaatacaaaaaattagccaggcatactggcangcaccctgtagtcccagctactccgggaggcntgangcnnganaaatccccntgtacccccgggaggtgggaggttgcaccagaagcccaaanattcgctacccacccactggtactttccagccgtngggccaaacaagangtggaagaactcttgtcttccaaaaaaccanaacnatnnaaaaccctgggcggggggccaacaagcnggcttnattgccctggtaaattcccaacaacnttttggggaaggcccccanngcananccggattcattgaagntcacggaaantgngaaaacccnnttcntgggcccaacattgg

SEQ ID NO: 2171 - DNA, 763 bp, Homo sapiens
  misc_feature (1)...(763): n = A,T,C or G
cnccccccngttntggttgggaggtnttctgaacttaaaaaggaaaatngcaaccattntagggactagttgcctttggangaaaagganaattgcaaacccttataaagaccaatttgcctttggaggagaaagccaatttatcatccaaaatcctcagaattctcaaatacaaaaagttctgaaaactgaaagtttcttcttaagtttggtggcaaaagttatttatagtcttgacttatcccatttgatgtgaatctgcttacatttcattgcacaaaatgtttctgtgattgtgaaatactgttccagaagccactgggaggtttaacttaataaatagtatatgcaacgttttactcttctaaaatctgaaaattgtgaattctgaaacatatctcagagggtttcattaagaatttttgggcttatacaaatttatgctacataaatgtttatagtcttgnctttctctgggatataccgtntttactttgcccttttactttaggccctcaaatcatgcaagttatattttaaattttgcttttgcctttcaaaantanctatggttactactatgataggtttaaggatggggaaaagggtaaatcttgcnttccatttttttaattttggnaantccanaattatggtttacctggccccaattttaatttttgggngttttttttccttcnaaagccgttaaaangttttgggntttnanggnccaaggggggnggnngggcctcaccncccn

SEQ ID NO: 2172 - DNA, 1113 bp, Homo sapiens
  misc_feature (1)...(1113): n = A,T,C or G
acgggggaggccctaccnggttaatgcggnaanattcngggnnnaacgggaangnnaannataggattttngtaaaagatatttcccaatgggagccaaantnggttcanctnggctagcntntctgnntatntgcgcnnaatctacgccctntancgtggccaantatggnatggggggttaagannanggctcgccactntgctntgtcntntactatctatatttatagggggggggggggngagccnctnttttcccgcccacactatctnggtatgacgccnntcnntctntcgcatggatgtggcacatantattgntntnaccatttaatgtntctgnnaatccatngggntaccacgganatatgtaannanttntatgcggcnctaggntctccgcnaaagtctattgnnnatnatgctntctncntactnccngcgtgaanattacgnctncngcccctnncttaannctgnntttntngaanatnctccntntacacnntnnntacncctanttgtntnctgcncnnccanaaatatccntnccataacttncangnntcgcacanngcnnaannnctntcccttctcccatcccatttnnncnnnattnaantntcgtatananttnngaancttattngaancganccnntcaacntngncgntctcnttntntaaattcgaagntctntgggnnnnaaaatgncctggccgccntnnaaggngnttccccnngnaacantcttcccnttgttnnangttgtggannntaaaatngggtnctnantncnangnccnaancgggctnggggagaanacattgnctnccgggtaaaantaaananatatanntccnnttactcntctncatatagaaanaannagnagnntcctctcnttttcntgcnnnaaanctattatncgncggtaatnggccnctagnaaacatnntgnnaaaannttcntntgncctcncatataantgccactaaatcntntcnnnaacntggtggggnttangaganaannttccttcagnnnttctnatnntgggatccnctnngnggaacannatnatttctnnncanngnggncaanatna

SEQ ID NO: 2173 - DNA, 736 bp, Homo sapiens
  misc_feature (1)...(736): n = A,T,C or G
nccnttcgctgggatggctgactgctgtggccgggctgggcagtgtgccccaacagctcagtgctttcctgacactccagtgtctggggtggttgaggagccgagttctctcttcctcccagaccaagttcctccctcgggtttgccttgagacgtgttgcgtttttgggccccgtggcctctccctgttaggctgccacaggccctgcttctggaaggtgaacagctcctggctgctgccgagagggttctcgttggggtcaccaaagtgtgcccggctgctatgaaaaacgttgggaatcttggtttcagttttttattctatgctaggttgtacagacttatttatatcatcgttttgagggactaatggaggcttattgtaacatataatattanntgaaaccatggaattatatgaaaatgatacatgagaaataangaaactnttttgctgattgnaaatttttgtgggaaattttgtgataaccttgagaattatacttgnttgaatcnaaggccacttcttctagaatttattggtcaaattctgncatatttaccttctaaatctnctctcaaaggggccnaaaagatacntatctttactgggaaaaaaaaaaaaaaaaacccccccccntttaaaacttttangggggccntntcccgnananccccncctgannanacccnttngtgngttggggncnncccccaccntaaaaaaccnccctcc

SEQ ID NO: 2174 - DNA, 835 bp, Homo sapiens
  misc_feature (1)...(835): n = A,T,C or G
tnanncntataanngtnccaggagataantagactanntncgcctncgaatgncntgccgctcggctcactgatattggagtactccganaagggggatntattttggcannnatgttncttttnnnctgntgtnttnaangcttcctatttttatancatatcgcgaacttngttcanaccnacttgcncnnnaacaanatnacagcccnnngctgtcngtgaantagcnggatatcacaccantgcanantnttggggtattggcnngacntgtgnctcgaatcctccagagtttnangcggngggaatcacangctctggtnnngggtgcntntggaaacattgtgttgcngaangcccacatgttatgcncaaacnaaaacntggcgccntttgngncatatgtncantganantaaattcnncnccccnatacctctatnngnntgtggtnntgnatgncctaanaccctatnantnnctcgntcntngtcnncaannggtccatcntnaatnagngannttctcctgnnnntttcatttgntaccccaagaacaananttncaaagtttattnnnaanaactcaacggaaantnnctttgttnctattaacaanaattaaaatncntggnaatnataatcaaacatagntnntantccctttttnnncgtcannnaataagctncgncatatacnngcnnaaatnnnagaataacantatnggnnnntanacnntacngnnanngngngtgcntgtacnttacatttctantaatggcagggntnanatgggttatctatatcangggnctntctcgaaaatnantcng

SEQ ID NO: 2175 - DNA, 773 bp, Homo sapiens
  misc_feature (1)...(773): n = A,T,C or G
ntntnttccannccnncaanatatncctaaataacatgtctnacntgntcggtaagacttactgcaccctgtnctataagatagaanatgccctgcccttacaagacaanganactgtagagctatgccttctaaatcttaanccactcttnagataatggatcccttnatggccagcccaaacatctcangaacttttantttgcaccgntctgtttttntttccatttatttaataccacnnattcactntattattatgaagccaatatcnacatnttttcacaangattctctnaagaaatgcagaantggccgggtgcagtggctcattcctgtnatncccagcnctttgggangccnaagcgggnnggattaccntgtngtcggnnagntcnagaccncgcctgacnaacatggagaaacccctgtctctactaanaanacaaaatcngctacgcgtggtggcacatgccctgcancccagctnctacggangctgaggnagaanaatccnttgancctgggaagcnncangttgcngtgacccncaacatttncnccattgcncttccagcctnggggaacacgnagcnaaaattccngtntcnagnaaaaaaaaaaaaaaaanacanntntgnngnccttnnanaantcnctcagnggngtttctttnccnctaaatcccannncatgnnaanaataaanctttgggtnncgtcttgggacnnaaccccttntttnnanaattnnccnttccnctcctctctnna

SEQ ID NO: 2176 - DNA, 1067 bp, Homo sapiens
  misc_feature (1)...(1067): n = A,T,C or G
gaannggggggggatcngtcanccnntgctanttnctggtgaaaggnnnannaatgataaattgattaattttactagaagaacnncganactncncnctaatntntggactggnggtggggataggagtnttgacgnctcacancacaatgngaattnagantgngngnnagtatatanatttancatnatagnntggcntangggtnngnggnggggngtatgtttttntncntatngccanacttgtgcatcacatgnttanacatganagcncncgatantatatttanttcntgtcgngnctnncntnanntnnttnnnnntnnanaatgtnattntatcgatngtcatgatgntantcnttntngccncgnnanananangtntacgcggnncnnncngtnnncnnnaagccncgtnggnnancnntgnnncgannantgncnatatactnngtnnnntnacntaantnaanntnatgnnccgganatacgttgtttnnnnacnacgaantannnatgtgntagacnagtagntntgttntaagaaaggnntnacgannntnatnnncnngacangnancnnaagcagatttgtnnantggtgttcggcaaagtcacancnangncacnnaggngtttgnntgtgagnnnnatnnctnncgnagaggnnanatctatannnnatggancnctnangtnagancatatctatntnnctgttnaattncggnnngtgggnnannnatcnntgatntnntanccncgtnnnaangtgncgcngatgtatcgcgtgntgntatcnnnatacnaaanatttaatannnatgncgcggnnttatttgataacggannngcgacngtgtgtntgntttatnntaccgcactncgcgtcgcgncncnncgntatatnangagtnnanatnnttgatgtnagatgtctngggangatntncnngttacgnacgcnntcngtagcnngnacncgntnggcnnatancgancntcgatttctatcanttntggnnnncgatntagacanatatnnagtcgncgatatngngn

SEQ ID NO: 2177 - DNA, 978 bp, Homo sapiens
  misc_feature (1)...(978): n = A,T,C or G
gatcgtgnnagattnctcanctctagnntcttaannctacnnaaatatgncattatcnncacanacntgcntcntgngatgcntgatngnttncccatcccttctgnatatnaaccancttgccnttccgagcancagtgccacatnnntntggnntgtnnacagtccnctcnccatttttcctgaaccganagntggnangactnanagtananaatgcaatatnttcnnaaccacttcnttaccnagannaanttnacncantntaaaccnnantattcttaaanaantttactcncnaaaacncctattatntaaantgccntttgaatnnaagnttnttntcattnnnggtnnatccggncngnagcctaatanngtgtacgntactttggccgcnttggatgngnngaactcttcattaanctgtggnnanggntcantaatnccgntcgggtatntcctttatgaancangaatcatatcnnaggnttannnctttnnngtctatncccctttctaggntancnnctaaaannacntgnggccttgnnntcntntnncaaaataatctcacantgnatgagcantgtangaanacntcncttgtggntaganaatnatctnatatantccanaccctctntnggnnaaaagnggcgnanacnttccccgnnantcngatagtangtccccngcctcntagtgacttttcntgnananaaatagaacatnacancatttnttncngcannnttncctcncaatggnatccccctnngggtcctttagntnatntcanacnatntaaggntgannttcctctctnaaanaatctnnctacangggtcacncaaaannggnatataangctcttntnctnttccctnggtngngagagtcttntnnatcttnganggatcccacaaccatagtntatattanttgggacgcgngngngcgggccctnttgtnngt

SEQ ID NO: 2178 - DNA, 739 bp, Homo sapiens
  misc_feature (1)...(739): n = A,T,C or G
cgggnggngcgaattctcacccttttagttctccaaaatttaagatacttgatttcttaggtaaaatgtttttgtttttgttttggagacagagtctcgctctgtcgcccaggctggagtgcagtggcgcgatcttggctcactgcaaactccgcctcccagattcaagcaattctgcctgagcctcccaagtagctgcgactagaaagcgcatgccaccacgcctggctaattttttgtattttagtagagatgggggtttcaccgtgttgcccaggctggtctcaaactcctgagcttaggcaatcctcctggggcagcctcccaaagtgctaggattacaggcgagccatggcgcctggccagtaaaatgttttctatctagaatgaatcaaggtattttccttgctcagtagcttctagaataagaaaaaaatagcagcaagatctgattcagaaatagttgggagcagaaagttaatatgaaggagttgctacttgttaacagcctagagttgagatctanaagaattattacctttttaaattgntgatgaaagcttaaatccacatttgggaagttactctattggctgaactattttggagttttggtaagctttggattaaanattcctgatttaactgaaacttaattttgccacatagcttttnaattncattcccangttttacttgnttttanctggccntnaaaaactnannaatttngaacnnn

SEQ ID NO: 2179 - DNA, 773 bp, Homo sapiens
  misc_feature (1)...(773): n = A,T,C or G
ncccnnttgcggngaaatactagcgctcctctactntctctaacggnaaagcagcnggaatacaagagactgaactgtatctgcctctatttccaaaagactcacgttcanntttcgctcacacaaagcccgggaaaattttattagtcctttttttaaaaaaagtnaanntaaaattatagcaaaaaaaaanggaacctgaactttagtancncagctggaacantccgcagcggcggcggcngccggcgggagaagaggtttaattnagtngattttctgtggttgttggntgnncgctagnctcacggtgatggaagctgcacattttttctangggaccgagaagctgctggaggtttggttctcccggcagcagcccgacgcaaaccaaggatntggggatcttcgccctatcccaagatctgagtgggacatacttttgaaggatgggcnctgttcaatcataagtgtgacaaaaactgacaaagcaggaancttatgtactcagtgangagncccntgttttgtctccaanagacgntttcnttttnaanactngtggtncccncccttntttggntgaaagcattgtttccccctgtttgaaagctttgnttaagggatnnnagngggntntgcactcaattttcaactttctttttctttccttggnannaannttccnttgaaannccttntttcaccaaanggggtccccancncccgnnatttttcnggaaanaaantaaaagctttcttttaatgccnna

SEQ ID NO: 2180 - DNA, 744 bp, Homo sapiens
  misc_feature (1)...(744): n = A,T,C or G
cntttttttattcgcacgaagaacgaccccgaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttganaactgtgtacttctggtgactgtacagtttgaaatactattttttatcaagttttataaaaatgcagaattttgctttacttttttttttttaaaanctttntttgttaccncacaaaacacttcattgttgtttttnggggaaggggcatatgtcnctaatagaatgtttccnaagcctgggattgatttgganaaaacacctttcccttctagtnttgaaanacttccttttgngtncccaaggangangggaatcccttgacttttgacacacatnggcncccttttgccacaaaanccnttggggttnaaaaaaannaaatnnggtttttatntcccctttttccn

SEQ ID NO: 2181 - DNA, 741 bp, Homo sapiens
  misc_feature (1)...(741): n = A,T,C or G
ccncnnntngntganaccaanaggtacagatgaaagtttttagttgacccatgaggcgaccagaatttcatggatgctctacagggctttcttgtctcctctaaaccctgctcatcaactaggaaacctcaggcttgaagagtgtcgaattatgtcctctgcaaaaaggccactgtggttgaattgggagaacccagacatcatgtcagagttactgtttcagaacaatgagatcatctttaaaaatggggatgatttacggcaagatatgctaacacttcaaattattcgtattatggaaaatatctggcaaaatcaaggtcttgatcttcgaatgttaccttatggttgtctgtcaatcggtgactgtgtgggacttattgaggtggtgcnaaattctcacactattatgcaaattcagtgcaaaggcggcttgaaaggtgcctgcagttcaacagccacacactacatcagtggctcaaagacaagaacaaagggagaaatatatgatgcnnccattgacctgtttacaccgttcatgtgctggatactgtgtagctaccttcattttggcgaattggagatcgtcacaatagtaacatcatggngaaagacgatggacaactgtttcatatagattttgnacactttttggatcncangaagaaaaaaatttggtataaaacganaaacntgtgccattttgttttgacacncgaattccttaataacngattantn

SEQ ID NO: 2182 - DNA, 770 bp, Homo sapiens
  misc_feature (1)...(770): n = A,T,C or G
nctcnntnttatctcccaagccannccttggatgaaaacatgnacctcttggaaggtatancnggctttgaagactctgnccnacagtttatctgccatgttgtgggtatcacttaccagcacatngaccgctggctgntggccgagatgctcggggatctgccgggtaacgccctctgggtcctggngnnatctgggaggttgggggtggctngggcagnggncctcagtcagctcctncaacaggcctgtctgggtnttatcaggtcagcatggaangcccancccaaggaggaaatangaacttggctaagacantctctgncttngaggganatcctatgccatttgctcattttatttttgcattaattgagtgcctncncgtgtgtcantgtgctaanctgggcgttccancattnnacaaagtgggatggctccnattcattctcatngangtancaacnncacatggcnacaatgggaggtgtccnntcggtgaattccctntcntnaatngaaanccnangacannnttacanaccaagtggccatctgaancccttnncctcccnttacannagaggcccgttggccctncntgtntntgcnnaaangangatncnccanttacngncccctgacnttntaacntttcntgggctaacccnaggntgnactgcgcccnatcanagctaaatntcgcgccaaaantcnaaaacttngngggtttgcanggggcnnttctaangtcatgntgnggccnttcc

SEQ ID NO: 2183 - DNA, 711 bp, Homo sapiens
  misc_feature (1)...(711): n = A,T,C or G
cctcctntccattcggcacgaggaattttttttttttttttttttaaanaaaataaaactttntttttaataanaaaattaangtttttagtanggaaaanccngtttgtctttcntttaccantncaancantnttttttccaaaanaatncntngggttttatngggccnttngtcngaanccanccccnggggaatntntaaangatcccctgctntgancnccaagtngaangtaagtttttnttntncttgggggaancaangggttcanntgtttnttgcanggnncanttgccanggganagttaancncanttccngnacccntcctgaanaaaaaatnctgccaaaaacaaaaatnccccngggtaaanacnncccntgaataaaaaaaaatcgncntaangngtntcaaatttttatttnttngggcancaanggactttgatcctttgncnggcttggaaactnctgccagcccaactcantacanngcanctanaantgnttccaatntggccngggaaaatcaaantacccgggggcccaaatgtttgaagttttttgaccacaannananaggaaanacaaaaanaggaaaatnccctncccttgntttaaaaacatntncttttttgccaaagngctttaagggnggaccgggaanaaaaaccttttttnncnccanacnaaagggttcaacccnn

SEQ ID NO: 2184 - DNA, 749 bp, Homo sapiens
  misc_feature (1)...(749): n = A,T,C or G
gcccntngncccngncccacagaataccnctggttggagcctgcacatcctccagcctgatcaaaaattattctgcatagttcccantgtgctttctgggagctatgtacttcttcaatttggaaacttttctctctcatttatagngaaaatacttggaagttactttaagaaaaccagtgtggcctttttccctctagctttaaaagggccgcttttgctggaatgctctaggttatagataaacaattaggtataatagcaaaaatgaaaattggaagaatgcaaaatggatcagaatcatgccttccaataaaggcctttacacatgttttatcaatatgattatcaaatcacagcatatacagaaaagacttggacttattgtatgtttttattttatggctctcggcctaagcacttctttctaaatgtatcggagaaaaaatcaaatggactacaancacntgtttgctgtgcttgcaccccangtaaacctgcattgtagcaatttgtaaggatattcagatggagcactgcccttanacattctcttggggggattctctgcttggctttcttggaactttntggnaaggataaattctggataanggcacttcaagaaancgtaacaacccccagtgcttttcttccaaatcattatgganaaatactattgccnntnncaaggnagaatgccaaacccccccacggnaaaaattttngaagnttccngcccaaatttn

SEQ ID NO: 2185 - DNA, 741 bp, Homo sapiens
  misc_feature (1)...(741): n = A,T,C or G
cnnccncgctgacttggcnttttcttctatttgctgggtagaaaagtccttaaagtggatgctcatgttcagtggcctgggcatatattgtttcactggtatcaataatattntaggatataattttctagcagctaggttttacatgtatatacactatggttcagatataaattacccatctctctatattagcccagttagctagtacatggataagtcattagataatttgctacccatgtatttgtcctattaagatgtagttataataaaattaccaagttatctgtagtttgctattatgggtaatatttcctcatgtaaactgtataaactcacttatatacatatatacacatgtacacatatgcatacataancacacacaaaggtaataaaagtgattctatatgtagctagtaacaagntaatttcagaatatttattttgtttttctctantggacaggngggaaaatatgggaaaggangtcttcagggctgcttctgacctgactangacatgattaaaacacttnggggagcctttagaaataaangggctgtgatggtcagaannttatatacnttttttnaccctatgatgaattttttttttttttttnannanaaanttccccctnttattnntttnngctgnannnncgaaangnccccttnttggnttnattnganacctgngcctttntggntcnaacnaattctncnnnctnancca

SEQ ID NO: 2186 - DNA, 795 bp, Homo sapiens
  misc_feature (1)...(795): n = A,T,C or G
ccnnnatcnaatcggccgaccaacaaaagtcgtgagtgatcactgaaagctctgctgtgaaggtgacatttgataactggggaagactgttcaggtaatgggggcacatgtgtgtgcanaggcctgaagaaggtgctggngtggcaagaatagccaagagactcatcactggacccgatggggagaggagtaaaagaaaangnccaagaattggaagagatggcgggcangtcatgtagggccttacaaagaatttgactttggctganagggganccgttagaaggttgtgaacagaggagcaatgtgatctgacttctcttttagcttttagtnccctgtacctgccttgtggagaacagccagagacaaggctanaagcagggactccagntagatggtggcatggccttagggcagngaggtttggtngnagttgtaatgtcttcaatgtcaagaaacttgaatttgacntgntccaanagcattgaganntcatggaannatgagggttggggttgcgnaaatttacntaatcagcaancaccccgnctcttgttcccctgttggcnataccnactcgttgtntccnattgtgttnaaattnttncnctaatgctctnccaanaanttangccccttanagaataattnatttnttaaggaataatttngccttgaaaagggccccattanaaacccccatctttttccccaaccccttttnaagttttnattnaaaaaaaacncnatanccttcgccccaantggacttnnngggccttatantccccc

SEQ ID NO: 2187 - DNA, 750 bp, Homo sapiens
  misc_feature (1)...(750): n = A,T,C or G
ngcncattnnttctgnacgnaggcccgttctccctttctnggtaaacggatgaagaaataaaaatgccattttcatttgtaaacttgtatttttgtatttatatttaggagtataaaatgtacttatatttaggactacaaaaatgtacntgggaaggtgacgggacctctatactcaggttaagtctcgactgcacactgacaggagtatgtagaccattccatttccctgaagactcagccttgttagtatcaggactggtcggcagatgtgcaggaaaaggtggcnagaaagtgcaagtnctanaagcagatgatatttccagatccacagcancccgaaatactacaaaangaaaatatatnacntagcctcttcagatcatcgggcagggcctttaatcctctgtccattacaaataaaaaaactttattactgattcatcataatgaacantattaaatttttaaaatcacataaagctgtgtcaattttaaaacccaactggccgtctttccaaggacataancnagcnncttaaaaaanaaccacattgatgaccacccaaccttctttgntgctccncttcggggggattcctacctttctgaactttggannacntcccgacangantctgaccccctttngnaaggngnnttnacntgancttgatngggccnacnngggaaattgtnggaagggtncncantaagtnggaacccnnntggtttcnccgganaattccn

SEQ ID NO: 2188 - DNA, 930 bp, Homo sapiens
  misc_feature (1)...(930): n = A,T,C or G
ttgaataccccgatggtaatttncaaccgnccccgtgnttntcgtnttcnncntggatcccctggtgcccanattannngntncttcannngtanagaangtaaaattcacaatctccttttttnatgggnggngacttntttctaatttgccacttattaatcntggncaaaatgatntgnccnagnttcatcnctatctgaatttgnncattacnccngcnatttctaatngcngggaatantcttactgctnaactnanccnttnncatttggaaatntttnggccnnatcaattangnnngncnnctttaanggcgggttnttngannctgnttttcgccntncntgctggtcctgnnctccccttnnnntcgnaanatngngctngtgnncnttngtttaaatantgnnnatcgcccntggnaantngtcctnttgnggnannnctccantggtangtcctgttttaantnnaatggcgcaaacantcgattngctnnctcatttcacgntncctcnntttttgtncttannnccnaatttanacncaaccnnnatttaacttagcaattcncgnaccnntttnnggtaaanntnttcnggntctcntcnaacanangganaantntttttacncncaatnnnccncggggcctnacanncacataaaattgnnttttcccnncctntaaanttncccctaattaatannggnattntcangngnnnttnctccttncaactcanatnccttggtcacctcctantataaaagncncntttcagtnnnntntattntccaaacnanntttnaaacnnaaaaatnntgggaccaggnanttctcaccntaannagcctacccccccntattnnnaaangaaantgnctcntttaagnntanccaaacnntaatccncccncgncan

SEQ ID NO: 2189 - DNA, 745 bp, Homo sapiens
  misc_feature (1)...(745): n = A,T,C or G
ncccntcnaancgncganactgattcnttcctttntttacaactgttaaaaaacctcaaaatagttctcttcaaaagaagagagattccaagcaacccatctttcttcagtatgtatgttctgtacatacttatcggagcgcgccagtaagtatcaggcatatatatctgtctgttagcaatgattattacatcatcagatcagcatgtgctatactccctgcaagaaatatactgacatgaacaggcagntcttggagaagaaagagcatttctttaantacctggggaatacagctctcagtgatcagcagggagtttatttgaggacatcagtcacctttggggttgccatgtacaatgagatttataatcatgatactcttcggtggtagtttcaaaagacactactaatacncatgaagccgttccagctatttaatgctggcaactactgnttaatggtcagntaaatctgtgataatggttggaaagtgggngggggtatgaaattgnagatgtttttagaaaaacttggngaatgaaaaatgaattcnaatgnttcnatggnaagaatggtgaacccattgctatcattccattcctggtctcatggcaaaaaaanttttggaacattaaaaaatcanaattaancccaaatggtttccttttttttaaaaaaaanaaaaaaaaaaanccnccccccntttanaacntttngggnngcntnnttcccacnancccca

SEQ ID NO: 2190 - DNA, 765 bp, Homo sapiens
  misc_feature (1)...(765): n = A,T,C or G
actccnnnnnannnnccgaggtttggggagagtgatggtagaaggactcccaggagggccctggagacagtgtgaaatncgagggaggtgaagatgcttctgtggctgcggagtggtccgggganggcagtgggaccctgcagaggagtggctctcttggcaagatccgggatgtgctccgcagaagcagtgaactcttggtgaggaagctccaggggactgagcctcggccctccagcagcaacatgaagcgagcagccttcttgaactatctgaaccaacctagtgcagcacccctccaggtctcccggggcctcagtgccagcaccatggacctctcttcaaagcanctgacatttcaacccggcccccangtctgctgggtccccccaccccccacagtccctcacaagcattccccattgctctctggctcttccccacccctaggtgggacantgaaggggagcagtttaaccagaagattgctgtgcccttanggtcttaanctcccntcctccaggaatccctctttaagaagggacccttnagganaccttctctgcnaccttgtggtacttttnagagtannctngcctctgaggccccaacggtggggtncaaaagccanngtantngccccntaananaatccancctgctggccggcttttcaagccaaaaangttttggggggnnttgncaaaacaanntngcctttgnccttggncggntnttnactcccttccttttggtgnttnaann

SEQ ID NO: 2191 - DNA, 754 bp, Homo sapiens
  misc_feature (1)...(754): n = A,T,C or G
ccccgnttcaatccgcncgaggggntcccaacttgccttgcagntgtnccctgagacctcaaaccagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaagtcaccacgcggttctggaaaggcacttgcctctgcacttttctatattgttcagctgacaaagtagtattttagaaaagttctaaagttataaaaatgttttctgcngtaaaaaaaaaagttcttctgggcccgggcgtggtggctcacaccctgttatcccangcaccttgggaggctgangtgggaagatcatttgagggcnggaagtttganacccttgncttgggcnacattaaatgnaactttcttttncangggagaaaaaaaaaaaaaaaagccttttgaaanccatttttttttttnttaaaangncaaaaaaanaaaattnccnttttngggnaaaaaaan

SEQ ID NO: 2192 - DNA, 782 bp, Homo sapiens
  misc_feature (1)...(782): n = A,T,C or G
cccntttnattcgcccgaggangcaanagnaacctcttccagcccnctgttcctnagaaggtgccaggtttccnncatcacacacntacgcagcgcctccntccactcggaaggactatcctgctgccaagagggtcaagttggacagtgtcagagtcctgagacagatcancaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgttcaagcagaggagcaaaagctcattttctgaagaggacttgtttgcggaaacgacgagaacagttgaaacacaaacttgaacagctncggaactcttgtgcgtaaggaaaagttaggaaaacnattccttcttaacanaaatgttccttgagccantcaccttatgaacnttgttttcaaaatgccttgattcaaaatgcaaccctnacaaccctttgggtggagttcttgaagaantggaaagaatttaacccctcaatngtaaaactnnccttnaaaattnggaccttttgggccataaanangaacnttttttattggccttacccatcntttttttttttttttttaancanattttggcnntttnaanaaanttgggtttttaaaaaaatttttanan

SEQ ID NO: 2193 - DNA, 1413 bp, Homo sapiens
  misc_feature (1)...(1413): n = A,T,C or G
aanggaggggnaaaggnnnnncggggggncnnnnanaaaaaaaaagggggaagaaaaaaaaaaaaaaaagcccngaaanagttnnnncaaaaaaccccaagggnaaaaaaanatngtttaaatcgaggggggnccngnncanccgggcnccactnnncaaangnggananaaacccccngggnggnaannngggggggggggnntnttttaaaaagnaaaaaagnngganaacacncacacggntncacgggtnngngcgagggcngncacggngnggnnaanacngaagagaannaanccccngagngcnnnngngncgccncagacnncgncnacacattancgaaaaggncggnaacaanntccagggcanaangnccggangcgactanannacngnaagggnggtcntcaannggggnaggccnncnaagnngacntcgcaaccacangantccaacggaanaacncgntnngggganggcnnaaangnnncccggannnnnggccccncggggnggaangancgaccccnnncanaggnggnnacnaacgacngntnaacnagggnncgntaganacannncgncaannggngncncncnganncgggncagnaatannccncngggacncgnggnacannnntnnnncnanggngncancgccaacaanaacccgnaatcgccaagccncnangnangnaggaaggtcnncanncgancagnaaaangcnngaagtacgancccgccgnccnngaaanacggnncagaantncggnccagncccagggnnatnggcaacanagcnnnnacactcgtnccnnnaccaggggacanatagnnncagatanacnncaccggagagnnacnncgcggcangccggannnacnnacgtgagaannacgccacatcaacgagngacgacgngncnacganagtcgacacgncacnnggaagcatccgnnnggcngcgcgaaananaccgtcagaganntgcnagagccgatatacnngncgaacgacnatacnncngngnagacatcgcgnaagncncganacgnnagggaagaaaaananagnccnncnanncccnngncaccacgnccccnaacacnncacgngatggggananaaaagangnntanncgnacaaggtnagggatgtgatgacnacgngcgccgnnccaancancannggagncgaaatacgacanggagccagacgngagccacccancgcacgnaaangcacggngccccgngccatnccagcgagnanagnnanctcgnncggtanacgggcggccnnagaggcggccanaccannacnnnnacncaccgagngacgagananancaaaatccacgnacgcgngcnntcanaagangacnncnnccnngnnaaangn

SEQ ID NO: 2194 - DNA, 745 bp, Homo sapiens
  misc_feature (1)...(745): n = A,T,C or G
atnnnnnaaaccaggggctcatgtaactgtgattaagctgtttgttggcggaattaaagaagattntgaggaacatcaccttagagattactttgaggaatatggaaaaattgataccattgagataattactgataggcagcccggctatcagcccggatgacagtgacgaggagaactgagggcacgtggggtgcggcagcgggctagggcccagggcagcttgcccgtgctgccgtgcagttcttgctcctcacggggcgtcacccccagcccagctccgttgtacataaatgccttgtggcagagctcccggtgaacttctggatcccgtttctgatgcaaattcttgtcttgtctcacttgtgctgttagaactcactggccantggtgttctactcctaccccacccaccccctgcctgtcccaaattgaaagatccttccttgcctgtggctttgatgccgggcgggtaaanggtatttttaactttaagggtaagtcctgctgtgagtggttacagctgatcctcgggnaagaacaaanctaaagcnggcttttgnctggtattttaattttttgaagttaaataaaagttactaattttgnaaaaaaaaaaaaaaaaaaacctcgagccctttaaaactatagtgagtcnnattaccgtanncccagacatgaaaaaanacattgatgaatttggacaaaccccactngaatgcnntgaaaaaaatgccttttttn

SEQ ID NO: 2195 - DNA, 766 bp, Homo sapiens
  misc_feature (1)...(766): n = A,T,C or G
agnnnnnncgaggaaggatctccttggttaccaaanggcctctcccttttccccccttctggttggaggagggagaagtgggaagtagcttgggaactggtttgtccacataaacttccccattgttccttggcccgccctcagggcagagccccctgcccaggctgggtaagagatgggcttggtccagcagggaccctgagggaacaaacccttttccttctggggagagagtgcccccccctaccatgtagttgaacaggggctaggagctccccactcccctccctctaacagcaggctgtgtgggtttcaattcccatccttcccaccccggctaggtgtcgtccaccctgtatcctgtgtctgagtgtgtgtgggggggttctgtactaatttccatggccggtggcttttccttccatgcatcactcccccccgcatgcccaggggccacccgcctggcattaccgcatgctggggtcattgggggaggggggtggggctcacgctgcctgtggtcttganatttttattttttgcatatgtaatccattctgtacangtaactaactttgtaaacgcttgtgtattccctnttgcccccatggcttgctggtgtaaaanaaactggcatctncccgtttggtaaaaaaaaannnnnnnnncnnnnncnnnncnnnnnnnnnnncnnnnncnncncccncnnnntnnnncnnnnnccctccnnccctttaaaacaatnngggggccttttaacccaaan

SEQ ID NO: 2196 - DNA, 918 bp, Homo sapiens
  misc_feature (1)...(918): n = A,T,C or G
atnnnnntncaaanncnntnnannnnnannnnnnnntncanannnnnnnannannnnnnntnnnnnnnnnnntnnnttnnnnnancnananngnatcnnnnanannnnnnnntncnnnnnnccancncnggngcngccgttttgaaatccntatnccanctacttgggttctttttgcaggaacccatccgaatccgcctnanataaacagtactctctctcaggattctcttggaacattcaactcattagtgagtggtcntccccagtcatttccatttttctttatttnggctctgatagttnactgtttttgtntntcagagataatcctttactatactaaattctacgtgattatattttccacctctatttgcctatatttaatctgctgacttttccttttccatatatgggcttannnnantgnttccctcttcttccttttctacctttggtatnnaaaaagtnacttagggactnnnnccactggcttacgtgtgtaatcccacnactttggcaggctgaggcgggaggatgcntganccccggngttcaaggctgcanngagctaccgantggagcccctgccactccagcctgggcaacaagaatgagaccctggctggntttnggggggaanaagttnatttcacaacgtttttgaaaaanattctttngcccaanncatggntggcncacacctgttaatcccagccacttttggggaggcccgaaggccgnatggntcancttngaggccanaagnttnnnaccanncntgggccaaanaatggngaaaaacccccttntnttncttaaaaaaaacaaaaaattagcccnggcntagtgnannccaanccctgnaaaacccaaaatanctgggggaaacctccancctngggggncaaaann

SEQ ID NO: 2197 - DNA, 855 bp, Homo sapiens
  misc_feature (1)...(855): n = A,T,C or G
ctatcctttcanctcttgttctttttgcaggatnnnatnnnagcncagannnaaaagctgtgtccttaatgacagcaaagttaagcacttcctttgtcctagagacatttattcattctaaagaaaagcccacgatgcttcagtggattgaactgttgacgaaacagtttaataatagtcaggcagcttgtgagtggtttttagatcgtatggctgatgacgactggtggccaatgcanatactaattaagtgccctaatcaaattgtgagacagatgtttcagcgtttgtgtatccatgtgattcagaggctgagacctgtgcatgctcatctctatttgcagccaggaatggaaagatgggtcagatgatatggatacctcagtagaagatattggtggtcgtcatgtgtcactcgctttgtgagaaccctgttattaattatggacatggtgtaaaacctcacagtaaacatcttacagagtattttgccttcctttacgaatttgcaaaaaatgggtgaagaaagagagccaatttttnctttcattgcnngctatatctacnatggtancatttttacattggggaaccaaaagggaccctgaaaatccttcaagtttggaagtggttatcnngaaggaagaangggggaaagaaagaaagaagggngggaaggaaagattatccttcttntctgggcaggaaagnaaaanaattncagggcccaccctgcccctttgaaaaaggaatggaatagcctntaagttngctcctttttnggggtngnaacaagtncttcggaatcaagaaaangggnggaaatngtttcccgaaattttnaaaaatgtcttt

SEQ ID NO: 2198 - DNA, 787 bp, Homo sapiens
  misc_feature (1)...(787): n = A,T,C or G
tatcctttgaactcttgtctttttgcangannnnnnnnancgtnttcngnccgaggctttagctgttagaaagganntttcgtgacatgacacagacacacgtgaacncncagcccgccggtcctagcagccagctgtgaaagctgtgtcaagtcacgggggttcccgtgtgtctgtgtcatggatgcaatgcgggccctggaggactgtgcgtcacccgtcaaccagagcgtgcctccgggccagcttccctccaaggaatgagtggatttcatacaggatctctttattgcacagactgaatggctttacatgtttctaatgtgaattaggcatgtgaagcagtgggtgtccacccgtgtccctcatgggtgagccctccagctgtgagcccaggcagtgtggtcaccgagtgaggaccctcctcaccaggaaccgnattcctgtgctgcctccacctgagagttgctagggggttcttgtcgagatcatgtcatcagcacccctaagtcaagtcacgggtttccatagccaggcaagttggtatgtacaattcagttcaancgtatgaacttgtatctctaatctgatgtccatttntatattttttgaaactgagcccaatgaaatcctttcttgaatcattttcctttnggataataaaaatatgggggaaaatgctatgatgaaatttatgcaataaatgtatacntgtgtgcaccttncccccatcctggggaaaaaaaaaaaaaaaaaaacttgngcctttaaaacttttantgagncn

SEQ ID NO: 2199 - DNA, 1305 bp, Homo sapiens
  misc_feature (1)...(1305): n = A,T,C or G
nnnnnnnnnnnnnagnnncngnnannanncngcgnnganancannaacnngaaaacgnnnnnnnnangannnnananngncnnccganngnnnnaaangnnnngngnnngngnannggngacnnancanncggcgaangacnnacgnnnnannagagngggggagngggaggngngngnnncannncgnganacnnngcanangnacgnganannannaanncccannnncncagcngcgccccttntngggnaaaaaacccccncccnttnagggcnaaacccnggccccnccnanttnanggacnnggganaaccccccaaaccgggnangcncccgngnccccgggggnggccgggaganaaaanaccaccngngggnnnnngntcnaagnncaaaccantcaanctntnggcaagnaccccncccantaggggnannanggaggnngtnagngnanaccaataacanaaggggccntcnacccnaccntaagcccnggaanatantgccaatgcngtancannangggaatnncaancgaggggaacanaggagccgtggcnaganggnagggngtgccncgcagccgcnnnacctacggaanggangtnagcacngaaacncaaaaaaaancaacgggggctnaaangncanaggcncnaatngcnannnncccnccaancaacctcntganaatganncggnaccanntccantgnnagaggaaaagaggngacacataaagcccngcangagaatgaagagnngctcagggacagntggnggncgaaaananagggcggntagtctacagnagggntcangggaaaaggncacacnnaaaccnatgggnaaaaaaacngangcccgnaagggnggcccancancttaaacggggnacnnntgnnacacgggaaccggantgnaaccaacctactcannaaacnancgcaangccngngggnggggnggtnaaacaaannganctacgnntganangggccccagnggggccannaaanannganagggggcatcgatcaganataaaacgnccnggggggggntcnngncagacnaaaangggggaaaaaagtaacaacancccccanatataccctcatcaaaaanaaaaaannggnggccacaggaanacncccnccgccanaanaaaaggacnacanagtnntngcaaacacnaggggccncacnncggnggcncaaancggagccatggggngattatnaaaaaanaggggggnanacannacacaaaanaancccccnnggggggaccngcgg

SEQ ID NO: 2200 - DNA, 856 bp, Homo sapiens
  misc_feature (1)...(856): n = A,T,C or G
ttatcctttcaactctngnctttttgcangatcnnnnnnnnncnggctgnncntgttaacaacatgttgcatctgtacgccagtatgctgtacgaacgccggatactcnttntttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtgatctcttccctgaagaacaggctgaaaaaggtctccacaaccactggggatggtgtggccagagcgttcctcaaggcccaggctgctttcttcggtagctaccgaaacgcttctgaaaatcgagccggaaggagccgatcactttctgtgaggaagcctttcgtgtccccactaccgctcccggaaccattgaagcangtttcntgncagaaacgcccncacaagnttgcaagnttnttcnaagccagnttaattggatnggtccgaattcagaatccttctcaaattttccgggcggaaanggttttcaanntngatngttttttggaaagaaagggaaaatctaaccattgggnccgaaatanccccntggcaagnngaccaaaactggtaccatccagtgggctttttcaactgtcccggaaaanggaaatcgggaaccaattttggaatactggtaaaananccaaaaccc

SEQ ID NO: 2201 - DNA, 781 bp, Homo sapiens
  misc_feature (1)...(781): n = A,T,C or G
ngagttnnnnncgaggagccatgcgagcagctngttcttttggagaaagaactgtaacagaactgatnttncattaccagaaccctcagcagttgtntgccaatctatgggccgctgtcagggctcgaggatgccagtttttagggccagctatgcaagaagaggccttgaagctggtgttactggcattagaagatggttctgccctctcaaggaaagnnctggtactttttgttgtgcananactagaaccaagatttcctcaggcatcaaaaacaagtattggncatgttgtgcaactactgtatcnagcttcttgttttaangntaccanaaganatgaagactcttccctaatgcagctgaaggaggaatttcggagttatgaagcattacncananaacatnatgcccaaanttgttcatattgcatggaagcaggactccngtattttnnncttgaacagaggtccctttcttttggntggtgatntggctccataaattacaacatgcngtctatcaatngattanggtttgtgnacattnagagatgcctgatgttctatcattgctgtncctttggaatatntttncaattttttnaaagagtttntacnccaaaccaggtgggagannncctattntttttaaatgccagnctnttatanaattnacccctnatttccctctttaattnnccncctgcaaaaannannanggatgccacctcggggtnncctaatttannatcanananaaaanntanctctnttccnnn

SEQ ID NO: 2202 - DNA, 850 bp, Homo sapiens
  misc_feature (1)...(850): n = A,T,C or G
nnagnnnnnnggtgcctcccaatncccagcatgttttttnaacnngnttccactanaanaaagacggtttanttangccttttcaagtaanangtgctnggaatggttctatgaatatgcaggnnggtattcatttgtatcatctnnnantgatccttannacaatnnngagttccttananangattaaagannntanaaatgngtacatttcaccnttgggtgtgngtgcgtgtgtgttcntgtnagagggagagagggacatngctgtaaccaatcnncagatagcctattttatagccagcancttaagccaaataatttcagancactanangggaacttgaananatgaaatgactttgggagaaatacttttggattgcttggnnnaacctntttggaatgcctgantaatgggtgatcatnnnggtcaaagcacctgtgntannaatnngctnttgttgcnnttgaancccntnctcantgcagntgcaatattcttnnatatntcannnccttttatttnggcaaanaccacncngggaaacaaaantgtttgtttttncncactttaaacaactggtctnttnaaactnacnttctnttctctttttgcnnantttacntancaactgggntttnggnnttaanaatantcgncgccgcccctgngggccnnaactccggtncntcggtggggctntccggccnnggtagtaanaaaaaaaaanccntctttcgcnnccccttcggttgangncgctnttctcncgnccactcccctattatcncatcnccnctcccttctnntctgncctctngcgaacatnaccccccccccttngnn

SEQ ID NO: 2203 - DNA, 754 bp, Homo sapiens
  misc_feature (1)...(754): n = A,T,C or G
atcccatnnnattcgaatnnnnnacgaggagctctctctggaaagctcgcactggaatggagaacacaagcaggaaatgtgaaaagtaacggttgaaagccttacttatgatgacacatagggaggcaggtgcatatcttacaattctagacacttggataccttgggaaaccatattgaaagttaccttgatttcntttctttcttttttttttttgagatggagtctcgctctgtcacccaggctggagtgcagcagtgcgatctcggctcactgcaagctccgcctcccagcttcacgccattctcctgcctcacctcccgaagtagctgggactacaggcgcctgccaccatgcctggctaattggtttgtattttttttaataganacagggttttcaccgtgttggcccngatttggtctcgatctcctgaccttgtgatcagctacttgggacctgagacangagaaatnctttgaacccaagangcggaaagttcanggagccaagatcgcnccnctggactttancctgggcaacgagangaaaactcttcttgaaaaaananaaatncnacnaaaaanccctcgngcctntanaanttantgagttntattacctaaaccaaacntgntaaanaaacattggtnnngtttggnccaaccccaactttaatgccnggaaaaaatgcnttntttggaaaattnngatgcttttgcttttttnnaaccctttttaacnncaataaan

SEQ ID NO: 2204 - DNA, 1412 bp, Homo sapiens
  misc_feature (1)...(1412): n = A,T,C or G
ggaggacnnanggngcnnannnacacacgggnnnnannangnaggcggngaanggacnngnnnggaggcgcagnncaagcgcangcgncnnanagaangngnnggnacgagcnnancagagngagaggggncgagggaannngnagagccgcngcanagnagaaaancnnnnngnngggccgtnngggaaaacccccccncaaannaccgcgggnanangaaaggaagccaaagagaancccaaatcgangagaggaggaaaangcnggggngngnaggggcgagcccctgtgaaggcaagcaacgggcaannnacaacananccanggcagacncntcangngggggaggacacngaaggngnngagnganccannaaagnngnaaggngaggtgacaganggaangggcnccnngnanngnacaaanaggnagnangcanangnanaggcccnngngggaacaanggnnaaangaggggagcganaaaagggggggnaannggngaacaaangangancngggangaaccggangggcgnaaggnggcggcaacggncgcgnnnnancgnggaggcgancacgagaaggggaaagcnnagngggcgtatggnagacgnccgangnnagggcgaagccgncaccangngcgaanacgnnnnnnnnnnagcggcagnnggacaagaaaactancncgagngggggggcnctcctagaatcgaaanannnannagcgnanaaagacgagaggggggggggnaccgnaaanaggggacgaaganccacgatntnggggggggncagaatanccgngcggcgtannncgcgaagagnaaaangagnggggngtcacagatggggngctgcnnggganaaaaagngaananagagggggancacaaggnggganangacacagcnggngnagaggagnngggggagnaaaaaaaangcgggacggannanangggggncnagagcccgccntggccacaaaannacncgtagctctccgcccccggggggcnccgcatgtcannacnntgggnggggggacncccnngngatggggggcgacatctgggaaaaaaagangggncanacntncccncagaaaagcaccancnctgngggancagangganantgggggaggggggcgcangaanananggnaaancccnttcggaancggnganacananaanaaanantnggccncnnggccnagggaaangggnccnaaaatccgaaaaaccgacaggaangacgatnngcaaaagaccgancncaannctgangtgggggggaaaaaagcgggannncaccaaccaagnnaanaaangcttnnnnaggggntngganggacnanncangtggnangancccggtcagacggggnaaananannn

SEQ ID NO: 2205 - DNA, 784 bp, Homo sapiens
  misc_feature (1)...(784): n = A,T,C or G
ttatcctttnaagctcttgttctttttgcaggatnnnnnnnnaggggtaannncntcaggctccaccatacccaggctcttaccttagcagaagcctgtgaagctggtagcagaaacgagaaggaacaaaattaactccaaggcagtaagccatccacaagaccactacacgaagttaaggctgtgtgaaagagggagcntatttaattttattgttaaagaggcaataaaatatctagagaaacagccattaaaaaattggcaaatccagcctggccaacatagtgaaaccccatctctacaacaatacaaaaattagctgggtgtggtggcgcatgcctgtagtccccagcttctcaggggactgaggcggggggattgcttgagcctgggangtccgaggcttcagtgagccatgattgtgccactgtactccagcctgagcaataagagcgagacccttgcctctaaaaatacattaattaatttaaaaattangcnaaagatgtgaacagatactttttccaaagaaaggtatatgggaccaggcacggtggctcatgcctgcattctgggaggcttgagatggcggatacctgagatcnggagttgacaccccctacccgacatggtgaaaccccattttacttaaaatacacacnccnccccccaaatttctgggcatgtggcaagncccctgtagccccactncntnaggagcttgangcnnggnnaatntctgnaaccnnggagncgcaggtgtnggnanccnnaccnccncttn

SEQ ID NO: 2206 - DNA, 779 bp, Homo sapiens
  misc_feature (1)...(779): n = A,T,C or G
aanaccttgaaccccgnnnttnnnnannnnnnnnccnaanncgtcaatgacaagagcaggaagagcgtttttgtgaaggtgattgacgtgactgtgcccttgcagtgcctggtgaaggactcgaagntcatcctcacggaggcctccaaggctgggctgcctggcttttatgacccgtgtgtgggggaagagaagaacctgaaagtgctctatcagttccggggcgtcctgcatcaggtgatggtgctggacagtgaggccctccggataccaaagcagtcccacaggatcgatacagatggataaactgccaagaaccagatttttaaaaggcccgcaaaaaatcttttcctgggagtctacaaatttggaaatgaaaaaacccagacatcagatgtttttattttatattattattatagaaggtggtaccattatcaattatgtgaagggacatgcagacaccccagcttttgagggtgctgggggtaggactgaggcagccccactgggaaccagactgcagcctgcccatggctgttttcccaaggatcaagttcctgganggaaaggctcttggccctgacttccgttgtgtcccgagcacacgtgcttgacccgnancccgcccgncctgtaattcttggctgggtctggaagtgtctgtggagcaccctgncctcaccacagganccgtgaaccncttnttncagtcccgctgaacatgggaaacaacctgaaaaagnagcagccctcccgtcagggaccctttntttgcn

SEQ ID NO: 2207 - DNA, 817 bp, Homo sapiens
  misc_feature (1)...(817): n = A,T,C or G
ctanccttnaanncnnnnnntttnnngaccnnnnnncgnggnnngcccaacatttcagattttccaaaatgtnngttaggaagtctccattgtctctgcattatnaaaatacactgttactatcttaatctcaagagtgtcattacagtgagaatctcatttaaaagcataccagtgaaattaatagcagtgcttatcaaagaacactgaaatctgtgagaatctttctaggagcattcttttcttcttttagttccaagttccagggtatttttcattcctagtaggtttatatgactcacagaatgtggacttttttcctgtttggagtatttttgtaatgtaagtatcggatagctgcaccacagcatgcataaattgcacattttgttttactttctttatagaatatttaatttcaaaaatataatttatgccaaaaaaagcatacctttcaattttgctacttggttgatttancacaaaatgcaaagtcttggggcagagagggggagtgaaaaaaattttataggtaattgttcaaaaataccctgtcagaaaccctaaagctgcattgtnaaacanatggtngtnaactagtttttgaaaaagtggtnanggaattngtgaaaaaaatcttnagacttaatggctctctaacccacatgangtttccttcttttttaatttaagtaaataccgcctgcttccataatttggganggtttttnggngttttgtaaggtcacttggaacaanacattggaaaacctggatttataatttgggataaactggnanccataaaaaaagaaan

SEQ ID NO: 2208 - DNA, 991 bp, Homo sapiens
  misc_feature (1)...(991): n = A,T,C or G
gcganagagaacntcttttggcaaaactcccctgggctctttttttgggcaggggaatccccaccccgaattccgnaaatntccgggccaccgnagccccaaagaaccctnccancggggccctnggngnttttttttaaaanccccccncnaaaangtgggancangnggaaaanggaaggggaaagggggggggacgtttcctccaagagagtncactcnnccctnnttgggggganggggggngccaattgggccctccanggaaatttcnttgggaaaaggtggngggaaggggaagnngccangggggnnttantatnaatccctaatcccagggnaaggggggangcctcttcttacaccaaacctcattctccccctcaangacctaattggacaatataanggaaaccncctgaagggaagaagccnnactgaaaggagggaaaccagcnnnnnnncggggnnattggtttttgnngggatgntggccgacacctaatcggaaanggnccctgccnaaaatanttggaccttctaattgaatnggactnggggggaaaaccaccganccttcaaatttangtccgcttgnaagnacagnatggaatgaactggntacaataaaaaccctcgnangcctngcattttnaaataagggaattnggncccaaaaaagaaaatcttgggaatnngggcccnnaaatttttcnggggggggggaaaaatttcaagaacttggnaaattgggggccaagnttgganccgaaaccccggaaaaggngggccaanggaagtttggaagttaccccgaanccccccgctttacccctggccctttgccattgggggggtccagggaatattggngaacctcccaangggaccatcgtcaaagtgggcttggccaannccnaccctccgggggaagggtnaaagaaccctatcaaggggnggnaanaanggtaaaacatggggccatctgggn

SEQ ID NO: 2209 - DNA, 941 bp, Homo sapiens
  misc_feature (1)...(941): n = A,T,C or G
nnngttnnnagangtatagtgtaagtatgaagaacatnntgcaactgtacaggtagtcaccagttatngtgatatgataaataatngggctattttgatgaagaaaactttgttcatttgtttctactttctaagagaaattgccacgattcctctgcttttcaacatttcntatgacttttttttcgggtgggaataaaaagctgtgaaattgtcaacctactttgtaaccaaagaagcaaagctgtgtaatggagttnggttttttttngngttnttttttttcgccntttttntttttataatgcncattcttnatgtattccntatttangcgtnntttcagcnncaattttctttactgtctagcatgatctgcatnaccnatancnttgaaccacttttgtnncctcatntttttattccacccaccctttatctgnaantaatngtcctancncttggggaacaacatgtncnaattaaaaangaagnaaccgaancaaggcctgntntnggngggganccntganncntantcggtncccantnncaacntanactctgntataaaaaaaaaaaaaaaaaaanaaagcgnngagcccnnnctttntcgnngntnccatttttaaaaaanangggggggtttttctggaaatttatccntcnnngccnacaaaaaaaaacgnttnttngnttcnatatttgggcanaaaatcntttaaaatggcgcnnttttnaaaaaaaaaaanggccaaactattgccaanaaattaaaaagtccncccaagtgggttntnaccttgggagcttnttttttaaaaanttttnaaaaaatgnggncacatttttttataatanaaaanccncagctntttcaaaaaaaaaaaaaaacgncnttctnattttttnggggggcnttaancttaaaaaaancattt

SEQ ID NO: 2210 - DNA, 786 bp, Homo sapiens
  misc_feature (1)...(786): n = A,T,C or G
cnattnnnnacgaggagcagctggcccgcactctgnttnctgaagcccacttccctggagctcttccganccaaggtgaatgcgctcacttatggggaggtgctgcggctgcggcagactgaacggctgcaccaggagggcacactggctccccctatactggagctgcgggagaagctgaagccagagctcatgggcctgatccgcagcagcgcttgctccgctctgtgaggggacgctcttccgcaagatcagcagccggcggcgccaggataagctgtggttctgctgcctgtcccccaaccacaagctgctgcagtacggagacatggaggagggcgccagcccgcctaccctggagagtctgcccgagcaactccctgtggccgacatgagggcactcctgacaggcaaggactgccccatgtccgggagaagggctccgggaagcagaacaaggacctctatgaatttggccttcttaatcactatnanccgtggggaggaaggaagcgtaccttnaactttcatttgcccccttcaaagcgggaattcntaccttgttngacangantgggcttcaatggcctttgcttngggcagtccccattggggcangcgaagcaaaacnccggcttggaccttggaagcaaccttgcttgancattggaagaaccaagcttccttcntgcttggancttngaanaaccttgcccattccccgaanngggcaccccccttgtgccccccaccccccaacaaantttaancttttgnttttgacnn

SEQ ID NO: 2211 - DNA, 766 bp, Homo sapiens
  misc_feature (1)...(766): n = A,T,C or G
gcngnannnncaaacagaccttctgtttcatgaacagntnntgttatatctgctaacccatatctaggnttncctccaacggctatgcccaccccancgggacggcacttcattatgacgatgtcccgtgcatcaacggctcgtgggaaccggaagacggctttcctgcttcctgcagcagaggcttgggagaagaggtgctttatgataacgcaggcctgtacgataacttgccgcctccgcacatctttgcccgctactctcctgctgacagaaaggcctctaggctgtctgctgacaagctgtcctctaaccattacaaataccctgcctccgctcagtctgtcactaatacctcttctgtggggagggcgtctttcgggctcaactcgcaggtacggcatcttcttctgtaagattctagaaccaccttcaagtcacattgctccaacagagtttttgcaacttgtagtaaatgggacncatcaaaggcaaagcataatgtgttttttttttctcaactagaatataatttgcngccttgactacccaanggaactggntgaagatatttctaaccaagctcatgggttaatctganccactgnggtttcctttgcccaccatttgggctctctttcttggtcttgggaaaattcccagtgnaaattttgttgaattattgtccaacctaaaggcagaaaaagttaaaaaagaaacnggtnatnaaaactttccncaaaattctttgaaaaaaaaaaaaaan

SEQ ID NO: 2212 - DNA, 1410 bp, Homo sapiens
  misc_feature (1)...(1410): n = A,T,C or G
ganacnncnnangnnacccntnngannnannnntncnaccgcatcnagnanangntgtngnnaganggcgagggggnggtaggncntgcagnancnncncccccgcggcgtnggaaaccnttncaacaaacaagggntnataganaaganccnctagngtaccccgcnagngnaggggcngnananntaggggagggcnnggcngnctnnnccnnaacgnngnntngaaatccnaacctggngaaacnggagggaantgatgcagaaaaangnacgatannnncgggacgcnanccggggcnannaaaccgaaaaaaatcagccccnangggaaangagggncnnnangatnatgaaagggaaangggaaaggnggaaaggaanaatngggnnaaaaanggctggggcangnacgacaatnagnanatcgnggaaannggccaaccgnggtgngccanncctcgncnaangaagcagncagnaacggannggcggatntccggngggngnngagangnnctcnaacgannagaataanggnagnggnggcangnaaggtntgtgngnacncatgcagatatcgatatacaganggagcgtgancnncaacacaagagancncgaaaaananacnagagncgngnngnntaaacgaggngnnnnacgatnacacgnatatgnngacanngggtnctnacatganacannctatgaaagacngacgatangaangcgaacggggtncanggcgcgcggtacatgcnnnanannnagcncngggngcgantcaccaantctgatgcataacnntnngggccacagnggnncatgtntanagtaacncacacacagngngngcncnntanccacgaagagccgtannctcnnggagaanaggggaanattacangacatatcnganctgtacgagganacnctgannatcngagagatgangctntgtggggagaanccgtntgaccccgaaggtngnggaacgacaccacacaaaacgaggaaantcagtgngggacangcgcctnnantanaanacgaaaantnnnaaacgaaaagaananagngcnnnanntgggnnnntcatncnganaaganaaagangcnantacagagangtncnnnngatgcccncagtnaagnanactggcgncaangggacaanacaaagtaannnntgggaanaangncgcagctnnnnnaangaaatngnnatcnnaatanngganacntctnaagancgacnggggatncgaaacagnacnngannaagnccngaaancnanntngantggngcanncgaannngnggnncnacgcgngcggatnacgaacaacaannacgaanangnagcgtgggcgnnanggcaaaaaccngnnagannagnctcgtac

SEQ ID NO: 2213 - DNA, 1170 bp, Homo sapiens
  misc_feature (1)...(1170): n = A,T,C or G
caggngggngaggagnnnanangnnnnnnagngncgagggggnaccacngnggaaaggggnnagagannnacgcgcgcaacanncagcttttttttntgananngnnnggngcgnaanaaccnaccnagagggaangaaaagnncgcggggggggnnnataaanccntgcgaggggaaacgngngcaacnncnnaangganaanaaattttgaggnaaaaaaggagacgncnanngnngaancnncncgnggagatnatagnnccccnncnncaaagnaggantngannnncnngagggcggagacnnccnncggagaccnnnaagcnaggcgaannaanancnnganccccncgnncgagcnccacnnncnnncccccnngaancnanaancaanncgncngncccngaagcggncncnncacgagancngaccncatngnnccccaggccnncnnacnanagcgncnacancnnncgnancacnccnannnggcnanantnanncngnnaggncncaaacacgccacccnncccacgcnanangcaanngcncacaaaaacggcncnncacccnccgancggtntcgacnagancganncngccaagnnancacgnngaagnccnaancnngnncganaacngcagagacgaggaacgagccacnccggnganagacngaccncgcngaacgangnanagcggccgngncagaccacgnanacgngcnnnacgcanaagagtnnacgcagacacgnnnacncggnnncggggggcacgngagaggcaccncanatggncngangacncacgngcannacgcnggcganacgnnccccnccgtgngaggnncccnagnnacccgagtncacccccgccgngcaccacacgggagcaccgccgcaanngnannaancnacgagnnnggagncaaaggangngcccgcgcntnnntgaccnncgncncgcngncacggncacnaactnngncgagaggatntatgcaccgnangancncaccccgcnccgnatgncnngcnccacacnncnnggagagcgacacacgncngagngngagcccnccccagcganggacncncnnagagngagccccncacgnctnggaagcagcacancaagggggggagcccngagggggngntacacnng

SEQ ID NO: 2214 - DNA, 753 bp, Homo sapiens
  misc_feature (1)...(753): n = A,T,C or G
tcaattnnnncgaggtcctccaagacctgattcagcntttcacacggtggtgccactggtcccagggttnnccggccccatctcctcagggcagtgggtggggaagactcaccactacccctaaaatgggaagagaccagggttccaaagtgacccccagtgggggcttcacacgccagggagtacatgagatgatttctgtggtccctgatacacagcttttcattttgagagacacaattatttgagtatctagtaattcaagcctgggattcaaagatatcatttaagatgaaactgaatatttctcttctggttaagatgaattaatgagggacgggtgcagtggctcacacctgtattcccagcactttgggaggccgaggcaggaagattgctttgagcttaagagtttgagactagcctgggccacatggcaaaaccaaaaatacaaaaattagctggcgtggtcgtgcgcgcctgtngtccccacttattcnggaggcttgtantgggagaattgctggagactgaaaaatccaagcttgcaagtgagcttgtngtcacgccactgcactncagtatgggtnacaganccgagacccttgtctnaaaaaaaaaaaaaacctntttatgtttattttgtnacaaaacatgactttgagccctgttcaggcntcaaccttaaattaagtaaaaaacnaattttttaaaaattttaaaaaaaaaaaaaaaaactcganctntaaactn

SEQ ID NO: 2215 - DNA, 806 bp, Homo sapiens
  misc_feature (1)...(806): n = A,T,C or G
ccgagtcnnnncgagccaagacctccacggccttgtntttagaaatctccacaaagtgacagtgaatgatngagggggagttctcagagtcattacagctggggagggtgcattgcctcatgaattcttggaaggtgtggagggagttgcaggtggttttatatatactattcaggaaggtgatgctctcttacacaaccttcattctcgccctcaaagacttattgatcatataaggaatctccatgaggaagatgccttactgaaggaggaaagcancatctatgatgatattgtttttgtggatgttgtcgacacttatcgtaatgttcctgcaaaattattgaacttctatagatggactgtggaaacaacgagcttcaatttgttgctgaagacagatgatgactgttacatagacctcgaagctgtatttaataggattgtccaaaagaatctggatgggcctaatttttggtggggaaatttcagactgaattnggcagttgaccgaaccggaaagtggcaggagttcgnagtacccgacccccgcttaccctgccctttgcctgtnggtcnaggatatgtnatcctccaanggncatcntccaagttggctggccaagccaaacntcngggggaggtttaaaaanaccntatccacgggtcgnaanaatgttaancantggggcccntctttgnattggcctcgcccttaangaacccttaacaagantacccnancgncaaggtcttgtnggcttggngttgaaaaaacnaccctgttnaanancagngcaattgcn

SEQ ID NO: 2216 - DNA, 789 bp, Homo sapiens
  misc_feature (1)...(789): n = A,T,C or G
tnatnctttcnnctctngtctttntgcangannnnntnnnntcgaattcnnnncgagattgcctcccagcttgggagcatccaaagtagaaccatgactgggtcatgaaatgggttaatttggtttctttcattacagggcaaagttctccctgtggactgagaaataaacatattataaaagttacatatgctcatagaatagaaatcaaagagtaaaaagtattgagtgtaaaaaacaagtgtcttttttccccccagtctaactccccagaagtaaccttttttattttttatgttattttttcttaccttcaaggaaggagaaaagtaaccatttttgagttgatgcgtatccttcgcctgagagctatctttgtaatcatcctttttggttcctttttcattttttgctttctttctgtcgtagctgctgtgtaatatagagaaaaaaaagtattttttcagctctctcactcaattacaattacacagaaaggtttctgtgacacatttgtgggagtttctccccacacagcaaacaggcagtcaattctggagagaggtcaccangtgggtgtcctctaacccaattcaattncaacattgtggtactcggagatagtgtcagatcccacangttganggctctgcccacaagactggcccccaacttgcccaccaattgcagctccaagctggtttacctgggcnttttgggccaaccgatataaatggggttccccaccccttcnttnggtcaaatnaattgccggaaccggctcacaaa

SEQ ID NO: 2217 - DNA, 881 bp, Homo sapiens
  misc_feature (1)...(881): n = A,T,C or G
gncntttgaanccctttcaactacttgttctttttgcaggatcccatcgattccgnnttatggnacgcgntgctctttcgcagntncncntgntnattccactcattggtganacggattccccanacattancattantctctatttggctctgatactaanctggntntgttgntnagagataatcctnnactatactaaattctacgtgattatatattccacctctanttcctatatttatgngctgananttccttatccatatatgggctnattttttttttccctctncttcttttctacctttggggntttaaaaagttacttaaggactnnnnccnctntcttacgatgtgaatnccagntcttttggcaaggcntgaggnaggngagggatatgcnngaaccnnctgtntttcaaagggcttgcncttnacgcttatngacgggttgccccccttgaaaaaanncccaaaatnttggggccaaggaaaaaatggangaaccccctgacctnggggantnttngggggggaagaaaanttttnttttnccaaatggtttntgggnanaattattccctatttggcccccaagacaatnggnggggcttcaccanccnnggcttagcccccaagccccctcntgtgcccngnccccncnggctggggntngcaatcnacctatnngggnccaaccaattntntanggacccctcncttgggncaaccaattggcnaaaaacccccnatntncttatccttaaaaaatttccaaaaaggtttgcccccggggaatnattggatanncnttnccccgntnaanaacnccaacttncttgggtgaaacnctnccaanacccgggnnanaaaaaaca

SEQ ID NO: 2218 - DNA, 794 bp, Homo sapiens
  misc_feature (1)...(794): n = A,T,C or G
ngagnannnnaaagctgtgtccttaatgacagcaaanttttagcacttcctttgtcctagagacatnnattcattctaaagaaaagcccacgatgcttcagtggattgaactgttgacgaaacagtttaataatagtcaggcagcttgtgagtggtttttagatcgtatggctgatgacgactggtggccaatgcagatnctaattaantgccctaatcaaatcgtgagacanatgtttcagcgtttgngtatccatgtgattcagaggctgagacctgtgcatgcttatctctatttgcagccaggaatgnaanatgggtcagatgattggataccncantagaanatattggcggncnttcatgtgtcactcgctttgcgaganccctgtancaattatggaaccatggcgtaaaacctcacagtcaacatcttnacanagtattttcgccttcctttacnaantttgcaaaaanggggtnaaagaagagagccaantttttgctcncattgcaagctatatctacaatggcacattttnacatggggaacaaaaagggccctggaaaatcctcaagntgaantgttatcntgaggaagaaaggngancaaananagaaggangaaacaaagaattttctcttcncctgggcagancaaaaaattacntggccnancttgnnccttggtaaaagangaataangttctncctnggctnctttccgntttgaaccaccctcgnatccagaaaanggccnaaatgttttccnannctccaaantgtctcanacg

SEQ ID NO: 2219 - DNA, 750 bp, Homo sapiens
  misc_feature (1)...(750): n = A,T,C or G
cctcaccccgaanntcntntatnggcccatnatatccttnantntcccnactccaatatccaaannnctgtcaaggatcacatactacatttggttctttattatagactttttaaatatcgtngtataccatngtgattctatccgtctcctttaataaagaggagaaccagaaaaatgaaaggncataagaggaatgaggtttggagaataggtgaaaaaaggcatcataatgtttataataatgtttgcctgttcagagaaacaagaatcacagataaagtcacttatatgtagatnagagaatgctgnattactttttgctattctattcactgatcatttttctaagaactctgtntgcttcttgtttaactcttatgtcagcatgtatgagaaaactganttaaanagatgttaagtaactcattcctgctttactagaaattggttcgatgagggacataaacctagcccggtgtgattttagatgctttttttaacccattgngtngnattggcctatatttctaagctnattcatggtcnctgagaagcaaatcatngttctacctatgactttagaaaagtnanaataaagatgttgggcaanaanaccctttttatttnggggttcnttttngaaggagcagantaactttggttcctngcattcccttgggtangctngnggcggggcgtccntntttaaatccntcaaaaangaaactggttaaccccttcaanccc

SEQ ID NO: 2220 - DNA, 757 bp, Homo sapiens
  misc_feature (1)...(757): n = A,T,C or G
ccccnnncnaatcgccnaaggttggaacaaaccntgttcactggagaggcctgtgcagtagagtgtagaccctttcatgtactgtactgtacacctgatactgtaaacatactgtaataataatgtctcacatggaaacagaaaacgctgggtcagcagcaagctgtagtttttaaaaatgtttttagttaaacgttgaggagaaaaaaaaaaggcttttcccccaaagtatcatgtgtgaacctacaacaccctgacctctttctctcctccttgattgtatgaataaccctganatcacctnttaaaactggttttaacctttagctgcagcggctacgctgccacgtgtgtatatatatgacgttgtacattgcacatacccttggatccccacagtttggtcctcctcccagctacccctttatagtatgacgagttaacaagttggtgacctgccaaagcgagacacagctatttaatctcttgccanatatcgcccctcttggtgcgatgctgtacaggtctntgtaaaaagtccttgctgtcnnaagcagcccnatcaacttatagtttattttttttctgggtttttggtttngttttggttttcttttctaaancgagggggggaaaaaagttcttanggttcaaattggaaagtttntgatgaaanaaaacccattggagaatttttttccaggggaaaaaaancctggcatattttgggttttcnnncaaatgngannccttaaan

SEQ ID NO: 2221 - DNA, 847 bp, Homo sapiens
  misc_feature (1)...(847): n = A,T,C or G
tttaanccctttnaactnctngnnctttttgcangatccntnnnnccgatnnnnnnncgagtacgaccatgaaatcacagggcttttgggtgtctgtaggtcttctcctggtgaaaagtgttcaggtggaaacttgganactcctgggacgtgaaactgggagccttaggtgggaatacccaggaagtcaccctgcagccaggcgaatacatcacaaaagtctttgtcgccttccaagctttcctccggggtatggtcatgtacaccagcaaggaccgctatttctattttgggaagcttgatggccagatctcctctgcctaccccagccaagaggggcaggtgctggtgggcatctatggccagtatcaactccttggcatcaagagcattggctttgaatggaattatccactagaggagccgaccactgagccaccagttaatctcacatactcaagcaaactcacccgtgggtcgctagggtggggtatggggcccatccgagctgaggccatctgtgtggtggtggctgatggtactggactaactgagtccggacgcttaatctgaatccaccaataaataaagcttctgcaagaaaaaaaaaaaaaaaaaaaactcgaaccttntacaactatagtgaagtcctatttaccttanatcccagancattgaataaagaatacattgnttnaactttngggaccaaaccccncaaccttanaaatgccatggaaaaaaaaatgcctttattttgntgaaaaatttngcganngcctttttgnttttnatttggtaacccatttntaaacctgnaaataaaaacaaggttaaacaacnaacn

SEQ ID NO: 2222 - DNA, 803 bp, Homo sapiens
  misc_feature (1)...(803): n = A,T,C or G
ccncgnatcgattcggcacgagatnangtcacaaattnatgatattgncctgggngannntnctacttgtntcccnaagacncataagctnctacaagactttttnaatggnnnanaantgantnatagcntcnncctgatgaatctgttgcttatggtgcagatggncangcngncatctngtctgnagacaannttgnnantgntnaaaannngctgatcttggntgnnantcctctntcncttgntnttgaaantgntggnggantcattantgcctcannnngcgtnataccaacattcctancaatgcccacacagacnntcactacctattctgacaaccagnctngcgtgcttattcaggtttatgaaagngaacgtccccntgacaaaanataacaatctgnttgncatctntcaaactccacaggcntaactgccnnccgccccaangtggttcnctcaggattgtnagtcccctttttgacgtntggaagccnccngggngtnccctncaagngccctcgggctnggggggaacaaaaaattttccngngaaccaaaaagnaccaaaggatttcccaattcacnttaaaagaanaaaaggggccgctttnnnnccaangggaaaaaccttttntgaccgtaatttgccccgangaaacnttgaaaaaccttnanagccttannnatggntnaacccggngggacncnggggggtaatgcnaanaatttantttgaancnnttttggccttttgaccgggaaaaancnctnttnggagaaatnngnaaacctnn

SEQ ID NO: 2223 - DNA, 1001 bp, Homo sapiens
  misc_feature (1)...(1001): n = A,T,C or G
aaanaaagttgttcganttaacganatanntgtngncagtgtntgttggccgattaatatncatnattganagnntgcattgtacnntgtgttntcatatgancattntattatgtaacgctgtngtngtgatcncatcttatatatanatcantttatagaagggggggggggagcnatgaatatacngtagagntgacggtnacatattgtatgatntantnncattanagcnagnatnanattnttntatattgtanncangataaggtntcataaatatagtttagtnacgnactctattncngaattnnaantntnnttactgngttangtanntgaactcaaacgtccnaataatttattnaattnggtcannacnnannatnagggtaatgnctatttgaanntcaaacantcctaaangggnggcgngantgngngntntaacnangncngnttnnagaatttatngcatnnantnanttannaattngttatgncnttanatnnantaaatggncagananttccnnatanaantggtttnnaannnncncngnctatcncntttaannannnanancnntactatnttannatnnctttnanggtaacnntanacnnnaanagnanangtttgngannttannacatctgntnnggaaaatatgcgtatnnannccatgngantntctnagcncnnatnatatannannnangatnantatgggggtgcntatatncncntganttnnnatanactatntnttgtgtcnngctcngaggtgacaannatatntncatntctcanacnaaagtatnttgnnacacncntcattgtntaagntccaacacnggagagagnagganagnagattttctatantanaaatactncacatnttatanatgngngggaggtgtgttttatttttntgtgngagaaaaannaatcattntctatgccataatganntctntntgggagannaaagagt

SEQ ID NO: 2224 - DNA, 743 bp, Homo sapiens
  misc_feature (1)...(743): n = A,T,C or G
tacccncgntcgaattcggcacgaggttactcagactatatttgcttaattgaattaaacacagttgcctatgccctttgaaattctggactttcaacagagggcctctagcccaatatttgcttaccaaactggacatcattgatgatctggattcaggcagggtctggaaaaagagagactgggccaaattaaaataatccattcactgatgacacaaaactaaactacaattgtttggcaccctctcttctccttatcttgcaaaatcaaattaagcactagtggaaagaaacagttcagagaggaatatgggaaagggaaaaaaaaccaaaatgtgatttccaacgagactagagatttgttctttatctacatggtcatgttactcatttgatagcatctatctcaggggtattatgttatctcttggccaggacttatgaaagttaanatttgcattgataggaaaagttttgcagaaatatggactcttgagagggtgggaggtatataaaagcagcanagcaatttgcatttcttatacaccctgcttgagactgatgtcattagtgttggttaggcccaaggcttggggggangctactcanaatagtngggtgacccaattaccccanaccttttggaaaaaggaaatgactttgattggaanaagcccattcctttnaaatgnatcttactgctcaaatttcccccattggccttttggaaaaaatgccccc

SEQ ID NO: 2225 - DNA, 1411 bp, Homo sapiens
  misc_feature (1)...(1411): n = A,T,C or G
annnnnnctgcnncccntnttgantnngactangataatnntaaaanggnnaccnnacgctnctattatttaatannacgaacncgcnccnggacnctaatgatatactnnnttctntgtanntgaaaangacatgtatntccncnangganngtgggtgaagtgctcccccccncctcttgnatatnctcnnangacttaatntataagtnatatgnacactcnccncantntttaaatgnanagtntgngggggngnggantattgtntatacaaacgccnnanctgtcnctcnanncnataacgntncnantatnnatncnacntgtntatnttttccncncatgtaagntnatatcattnncgctgcantnnanatatnctctncnctgtttcaactnnctctnccntanccgnntttagnnntntgtntntgtgancnacncngnncgtatanaattntncnccaccacnnnantgatnnantttgttnnntnagtgtnggcctatcnttcggnatnttacatataaanannntatctcnnngncgggacatnncgncnttnctggntangnagatnngngttntntgnttgagtannatggnctgnnnnntggantcnnngttttantngcngtanannntaactnacnttcantgnagattatanttcgctaananntntccntancagtagacgtcnccgtggttgatacanagtacntacgcgccncntcaatgncntctgctacacncanacttatgtatgtgtatanacgacnatntancgcgntacatttnggcangtnncnagngnntagtgcccctccnattntgagncacacnccctgtttgntanatcccagncntctatatntgttatatnggncagcngngatangtnatatnctnnnancacccatcatntantgatancgcagcgtcnntgnngtatatngtactatncccanatntnctttgattntcncactgctcatgatgatnctcttntattgtttttgtgntanncncgntcntatagtcgtnntntggaganttgntnngtgnatnannttnncgcngnananaatatatatngatgaaacccnacaganacancnatgtgtnaacntntnggtgagnnnggtntnnagtgttgtntcgcacntcggtntgcgacgcnagcntgcnntccgcgagttatggtagttntaannatatagntatntgccgagnganagagtnatgatantggngtcncatnnatcattntctgatacntntgntgtgntaccnaccnagttcgnttgtntnnangcgagtatacntntactccganacagngtatntcntggcnatanntgatanacnnnncnctgcgtntntttatacatnatctntgnnanaga

SEQ ID NO: 2226 - DNA, 783 bp, Homo sapiens
  misc_feature (1)...(783): n = A,T,C or G
nctnnntnaaaatcccccacnaccctgattnaaagtangaccttcccatangggcgcctttgtgtgctaaaggcagancaggcaggcttcnccactcctatctcctncgnaggccaccaccatcacatntataggaggaacaagancactgggggaactctggagtatgagtaaggaaatgcttctnaccttntctgntccaaagagatatctgttanatcagggaacnagtccnctaggtcaggcacttcctcctgaccagtgcaacgggcactccaggttanaaactgngtgtgctccctctctgtcagttacttgtctaagggctcctatacgtggccatcaanctctctggncntgagttctgtttgngcttatngcagcagcatctttacaacaaacaggntcagtaatcaacntgggaagggaaaaagacnacagtcaatnttaccccctgtanagccgggangcntttacacctgnaatggccttcttaactgatttctngccgggcccctcacccccatccaanntctgaancttgaacaaatncccacggcaccagaagaggnngtctnnctttgcaanctcccaancccttggacnaaaaaaanaaaanctggaagcntggagannggcttttacggcanccnnngtnggncccncgnnccaaacttggttcnggncatttatttttaggntttcccccaaatanntcncttggagaatccactntggantttttnccttanntttctntnaaanaaaaaacccaggttccct

SEQ ID NO: 2227 - DNA, 829 bp, Homo sapiens
  misc_feature (1)...(829): n = A,T,C or G
atgnnntnnnttcgttnttcctccacagtttatgngtanananattaatatttacntcccatacatnaatgtntctatatgngtatgatgngatccgataaccnttatantgtatccatcctcacancgcgatntanntnttatnanggtcnctnacgaacatgctncatagnnntatgtntataancnttctnngtgatnagtggatngnctanggcncntgnacnancgggngggnagttttttgtatcnganataaatatgcgacgttcnntatatgtangtntaacatttgtgaacgtanancntntaanacnctatngantctcnnnncnatggnnncananntnntaaccnatnaccctttctntttcgnacatgtnnncgcatnnnttnttnnacctatnatngnnanngaatgnatgatntnntnttncnntnttnnngttttcananactcanttatnncatngccnannactcatntcnntgtaaccnctattnncntccnnantanncntntctgatncgagtnnnnncnntttnnntngtttctggccanncanncnntnnnnnntgatanncgnnannnccacgatgnntnaagntaannnaataaaancngctgcctnttgntatttntggaananttcncnntntngnncnaattgangnnnnnnaganccgcnnnnnagatnantcgatttaccnttncttnnanatannannttnnncannnanttgnnctganntgtgnnaaanatgctnanacannnccnatttacannnctatnttacnacntannaannnangnancacnnntncaan

SEQ ID NO: 2228 - DNA, 1341 bp, Homo sapiens
  misc_feature (1)...(1341): n = A,T,C or G
ntnncnncanantttnccnnanncgcntattnntntntgagncctnnctnttnnncnatcnnacagttgncnnantctnanagntnttncnaattcntnntctgctntantggggggggnnngngtanataataattntaattngtaatntttnatnntgnnacnncngncnaaggttncnctcattngtnnngtntnntnngattngntnnntcanncctttgtcatanngtgactgcggggtgtncantncncctcgntnatctggntntttnannactctngntngctttgtnattctgntatgcancntaggantnaggagtnacntttntcnangtagatagnttttnacntngtcatnnnnagtngncttatnngatgtnttanatcgtcntcntnangnaaancctctncgtgaanagctttatcgactnctcttnanatntcngtntattnaaatcttgnntnantcncnangatcatgactntcacgcgaaantatatgtncatactcatataanagatgtgtgacgtgcgatnatactccntcgcgtgatgtttanccacnacananactancncagcntntattnagcnnatatataagtagtatcanccatantatnntgtttatntcnatatnacnaataantantctnctggaacntnngngccaaatnnctntgatgntacnnccatgtaatatgtctnntnctnnttcnnnacgtctttttatannagttgncnttncgantantgtgnnnctatnnacgnncganatatnnncnatgagntancgtntntntacgcacatacacnnnnanaatagagtcacnctgcnnntacacntnngtntacggatcctatnngcgagannncangtntangannncgttntncnnnttcgtnnntaacntattgtangnagcnntccatnnangatgatacancnttgtatnannngnntcgagtgtnnntcntacatcnagacgtntntnanttagncntctcnatntngtacgncgccgtntnattgngacctctcnatctnngagnnngctctccnccgtagnnnatantatntanatttgcgtacataatcttgtntactgntctancgcnnnntgaccatatcttnngannatgagatgtgnnacnntgttaacgacncgacgcncntannagagnttgtnatnatagtanatngnttagtnnananantatnnatgtaganactncnccaccnccatanatagtanatacgctcannattgtgtcatcgtacgagaaatganagangttttttnnagacgatnanagtactcggangnantgngg

SEQ ID NO: 2229 - DNA, 727 bp, Homo sapiens
  misc_feature (1)...(727): n = A,T,C or G
accncgntcgantcggcacgaggcggactggtatccggggactgtgacttgcagggtccgccatggagccagagcagatgctggagggacaaacgcaggttgcagaaaatcctcactctgagtacggtctcacagacaacgttgagagaatagtagaaaatgagaagattaatgcagaaaagtcatcaaagcagaaggtagatctccagtctttgccaactcgtgcctacctggatcagacagttgtgcctatcttattacagggacttgctgtgcttgcaaaggaaagcttgcagtcagatcaagaaactgaatactgccagcatctcagaagccatccatgtgaccccttcaagtcattattctttctgggaccaccaaatcccattgaatttctagcatcttatcttttaaaaaacaaggcacagtttgaagatcgaaactgacttaatgggaagaacagaaaaatttagttgctactgtagatttacatgattaagaggcagctttaattgccatgatcattccctctttttggatgtataagaaccttccggacaacagaacctatttctggaattgcagaagataacatatttcccttattttgatttaatcaccataaaccatacctatttaatgagtgtattcttgngcaattttttcttcaaaatggctttactttggttttaaaatgaccttcaaaataactgncnaaacancattt

SEQ ID NO: 2230 - DNA, 825 bp, Homo sapiens
  misc_feature (1)...(825): n = A,T,C or G
accncgancgaatcggcacgaggctaaccttacacacttgncctgtgcctttgttgtcgtatccctatgtaaataccttctccaccttcccattccttcatggatgacttcccagaccttcccactcatcttttgaatgtgtttattgctgacttggcaatgcatcaaaatctttttttttttnggccncaggtnttacngntttacagggggaatcccccangaaancgtaaaactntttgcaacttatgncacacctgttnttcaagggcaaggatnattngcggctatagttttnangccnnctaaagtccctttnanggtcatatncatagcanaanncncngggataataattattnaaaaangactnanannggncaaagtngncncaggaaattccnaaacnctttaataaaaaactggaaaaataaangttggngannacctatnnaaccnctttaaggncccgagtaatttttttttttcnccggnttcccccttccatggncttntnaaaggaaccnngngaaaaaggnanccctcccnttntnatttaaantaaaaaattctttcccttttggaaaaattttaaactttnnatttcnggggaangggnaaggaaaaaaaaaaattttgaaaanntgtcnanggtttnacccntccccttnggganancaagattttttccctttttttngggagggtctttttanantttaaccnnggggccntnctaaanggacatnggggaaancanacanngggttttccttgnccaaaaaaaanccntnncnttttttaaantttccgggggnggcanaa

SEQ ID NO: 2231 - DNA, 736 bp, Homo sapiens
  misc_feature (1)...(736): n = A,T,C or G
nccccncccgattcgcacganctcantctcttgacctcatgatccacccgccttggcctcccaaagtgctgngattacaggcatgagccactgtgcccancccctcccttccttgtttttgtaaaataaagtcagagaaacttttccnnntatagtcaactaatacacattgatttgaaggagtnnaaactgagggagtttacataaaataacttctctgtgaagtattagtganatgatcangcctggggtgggagctngaagagaggagtggataaagcagtcaaggtcaaacaggagtgagacagngagcaggactgaaggcacangtgaaggtgaagctgctcatgtnntttttctcccacagcaacacgcatgtatatagctttgaagcangaacagaaaaaaaatagattacttaggttgatccacctgaactaagcaggtattgnggncattcattgnggagaagcactncagtganagaggtgagtanatatggtgagctaacccangagtcanagcntatgtgannctcggagagaactgaacagntcanaggtcggttgccngaaacnnaggaaanccgcaaggnaagctgggagagcggtcncatggnatttacnctacncagggaagcnaannnaancagggccaggctangctnagtgggantcttcttccacggtccatgncctgnnccatnttaanggagntgcaangttcattacgacga

SEQ ID NO: 2232 - DNA, 731 bp, Homo sapiens
  misc_feature (1)...(731): n = A,T,C or G
accncgcntcgaattcggcacgagtgagctgggagaaggggagaaagtttgtgaagaggagatcggtgacctgggctccttatgtgcctgaaagagtttgagtttcctgttaactccaaatcaacagtattttcaacaagaaatgtgcaattgaaatcaagtgctgtttaagtgcagctaggatttccacaggaagacacttgcagtgaacagagttatggagcagcaaaaacacagatctatttggaaaaagagaaaacatatgcgttgtattttgcttcaattatnaaataccatcctctcaaaggtggttctaaattacaaaggactttgatttctaggtagattctgggtagagacttcctttcatattgaggcattaatgacaccttttaacctgggaagcaatatgactggagttgtactttgagaagattaatcaggtttggntgcagaatgaaagagaagatgaagtcaagagattggtttagaggctctagcagaagcttagtcntatttcaaaatgatcaaatatcaagaaaaattctgagctgcataacttgtataaagtaattttcagtgatttttttcatgggtatgataaaagaactggattagcagaaacttttaccctgaatcaagatttaatttttcttttgacctcattntaaggatatcnggacatngggagcnaaccgatggngngnctgcctcagngcttgattttanct

SEQ ID NO: 2233 - DNA, 840 bp, Homo sapiens
  misc_feature (1)...(840): n = A,T,C or G
ttgancctttcaactccngnnnttttgcangannnnnnnnnnaggagtcgnnncgagggtaaaaggtggagaccatcattgtggaatcttgtattttctattaaggtttntttantcctacaaacttgaacataaatttttaatatttgggaaggaacattcactgaagaattgataatanactaaaaaatatagctgttatcaattaatacatgatctgtccttgaacacatattcaccattatgtaaacctcacattatttcagcttatttattccacagataccaatagacatgttttcacattgtagcatctcccaaatcaaaatacttctaaaaattggtagtatgtcggccgggcgcagtggctcacgcctgtaatcccagcactttgggaggccaaggtgggtggatcacctgaggccaggagttcgagactagcccggctaacatggtgaaaccccatctctactaaaaataaaaaattanctgggcatagtggcaggcatcttgtaatcccagctncttgggaggctgaggcagganagtccncttgaacccagnagggtggagtttgcnggtgancccaagatcatgccaggcatnccaaccctggggtgacaaagaagcnaaaactntcaatctnnaaaaacctnanananctttcnntnctncnnnnnaaaaaacnncgaancccttncaaaaacttataggnganncnncanttcnccgttanaaccccnnnctngactaagaattccnnctgnttggantttnggnaccancccccnnccttgaancgccnggcgaaaaaaaactgcttttttcgggnannntttn

SEQ ID NO: 2234 - DNA, 728 bp, Homo sapiens
  misc_feature (1)...(728): n = A,T,C or G
acctcgattcgaagaaaangangaaacacaagaaagagaagaagaagaaagacaaagagcacaggcggccagctgaggccacctcctctcccacatctcctgagaggcccaggcaccaccaccatgactccgactccaactccccctgctgtaagaggaggaagcggggacacagtggggacaggaggagcccgtctcgcaggtggcatgacagaggctctgaggcctgatggctggaccctgctcactgctgttgtgggaccctgaaccctcccttcaccttgcttgcctcctgcctcggaagctccttgggtgtgggtgaagcccgaggctgctcctgtggaagtggctctgggcaccagcctgtggggctaaagacttgacagctagctctggagcagccggcttcctggaaaacctccaggtttcgcataccagggatggcccctggcttggcctgcgaaggtgaacctgccagatttatcaagtagaggctggactccctctgtgtcctgcccatggttgcagcagccatgggcctatgagcggtctaactgtggccaagtatggtgacctctatttttctttatattgactctttgnatttcaataaatatattttaaaanngaanaaanntccatcnaacccccncnnccccccccnccntcaaanntttngggggccttnttcccnanacccnnncttataaaannccntttnancntca

SEQ ID NO: 2235 - DNA, 733 bp, Homo sapiens
  misc_feature (1)...(733): n = A,T,C or G
accctcgntcggtcctcctcgtgggcctcccaaatgctgggattacaggcgtgggctcccgtgaccagcctggaacgtgctgatgagcctctttttctcctgaaaccccggtgggaacagatggtggatgcttccaaaagcatcgaagctgtccatgaggacatccgcgtgctctctgaggacgccatccgcactgccacagagaagccgctgggggagctatggaagtgacccaaggctgcccactggagacgcctctccctgcagtcccccgagaggtgggagactcgcggaaggccccgtccccagcggagtccagaccccacaacttcaggagctctttcccggcagcagagatctgcaggctgcctcttctgccccggagctggggtgcactggggacccccgtggtggggaccttggcagtgtggacatgagcagagcgatggagcagtctcctgccctctcccctgtcctgatggcactctgttgtattttcttactgaagttcagtgataactctgagcagtttcattgtgatcactgtaaatggtaatcagttggaattctcctaaatgtcttccagacactagtaaaaaaaganctgaaaaaaaaaaaaaaaaaacctcggncctttaaaaactntagggngtccttttccnaaaccccacncctgaaaaanncccnttngtgagtttgggncncccccnaccnttaaaaacnnnccnnnnca

SEQ ID NO: 2236 - DNA, 823 bp, Homo sapiens
  misc_feature (1)...(823): n = A,T,C or G
ntttttggggggtgtttggatacattagaaattactgctnganaaaaanggtcctngagtgggtttttaggannaanccgtannctnancgtgntncatatttncnngngccctacaccancnctagtggnattgtcacttcatccgnctggatatcanaacgtgttcaggaacactgaagttcatnagagaaattcacaanctctacgaanncacngtnatttctttttcctgggctgnggntggactgtggatgacaccactttccaggcccttttcttggaggcngncaagcntaaatctgacctanaacatttcatgctggttcggagaggagacgtanatgagttcaaaaaagctttgagaaaacatgctggataaggggattaaagtcatcttntatggagatgactattgcccgatcnttcanaatantttcaagccgactgaccatgtgagatntccacaagggngcacnttatnggatggcgngagaaangtcaantttaatggtttatccngctngcacacnngtgaaatnaagaagnctgttntacantgaancccacctaaaannaaatttnnnanccgnntantanccangtntgntaagggtcntattacnngaaatgtgtcttanacaaagnaancnttaccnngaacccnancnncnatttccccaaaaaaggtgaanccaaattnnctcccaaggtttttaangggcnggnngtnccaaaaaaagggngggaaanngtntgcaanangttantncccttcnattnacnccntngggttcnttngaanattnccgggccncntngnn

SEQ ID NO: 2237 - DNA, 729 bp, Homo sapiens
  misc_feature (1)...(729): n = A,T,C or G
cnccccanctanctcntggtgggcttcaaatttactttctcccctctgccagtgctgctaatggaacaaacagtaaatctgtagtggctcagataccaccagcaacttctaatggatcctcttccaaaaccacaaacttgcctacgtcagtaacagccaccaagggaagtttggttggcttagtggattatccagatgatgaagaggaagatgaagaagaagaatcgtcccccaggaaaagacctcgtcttggctcataaaatatttattaggggaccctcaacatgtggtcttacaatgctgcaactgttcagtgagctgaaaatctgaatcagaaagctttctcaattgaacttataaaatatacaaggagtagcaaaagacagnatatcagctaagagagtttagttctaataaaaatcaggcttcccaggaacttgattgcttgctagtaattaaggggtttgccttttaggctgtcaaaacaaacattagtaaccagaacctgggagatagcttcttcagcaaggaaaagtcacaggtttggggacggtttacgggaggggaaaaggttgatataataatgccaggttgctnctcgggtgtcgatctagaaacaattttacagaacttcagttgtaactcaataaccttacttgnataatnggggctggccatgttgtggtttaatcagtggctctttttaaaagaaatttttttggnaaacnt

SEQ ID NO: 2238 - DNA, 1200 bp, Homo sapiens
  misc_feature (1)...(1200): n = A,T,C or G
aagggaagaggnnnnggggnnnnanagncnggnancgcaagagaaaaanaaaaaanagnggaaacgncnacncaaaannaaaatgntggtcgnggcnaaancacccanacgcnnnnacagnnaccanacaaangngcccacgaggccgcggnggtttnttacgnacnncccgnnaaancncccaccnngcggcngcgnccngngncnacgnaannnaagagaaangggccgagaggaaccggtanggcnacnaccnaanaagnacagggaaaagngggcacacnactccnnaccnggaaanannangcaanagngcncngacgnncnnacaanncaactcagngaagcaancnagnccccgngacancanaanaccnagcntncngagacanancgggaancaacggacnccnancnaaccaacaantgactagacangnnaaaacccnangnnngacnccgacnatcnggnagcgcgggatggcnnacanngaagtaccgccancaaaaatgganncctnacnngggccnggacgcaagcaggcgggaangnntgngatananannnanacanngncnggnagggcaaaagggcgcnnatggaanaaccngangcccagacanaccngcannaccagggtcgnncnanacatnacggccanaacncncacggcggcacgcnaaaaacganagncancnacngcnnggggagcacgancagnctnnanganacngtgangaanncaccacaccacnacctnaganncagcntancaggnaagancananccccccnncgaanagnccaaggncacnncncgcncacaacaggcncgcggngcancngngnanngangccaaacganctnccccncacnaccganacccgccggtnnaggannanacncnnatncgcaggcaanaaaanataanngcanacccncccgantnnngnanactnncncncnaaacanncgcgncnccgagtcgncgtnanagtataacgcgcnnaggacgcnnacagacngacatngtangccaccccggnnncntgactangcagacgacccnccnacnnacgcgcnnnngatatcnccgccnngcaaacgtccaacacccnncccctncancacgccngtggnnncgccccaccanaagaccgncncncccannnancccnncgcgaaacacgagnggngn

SEQ ID NO: 2239 - DNA, 735 bp, Homo sapiens
  misc_feature (1)...(735): n = A,T,C or G
ttaccncgntcctcagcagggagaaaaggaggcagtgggcacagccgtggactatggctacttcagattcttccaggaccggaggattgcccgctgccccttccacacgctgatgccagcagagcgcgagacgttcctggcgcggaagcggctcctggagtacatgggcttgcagctacggcaggctgtctttgccaaggagagccagtgggaccccacgtggctgtacctgtgcaagagagaattcccttcttcaagttctgctaccagtgtggccgctccatcggggtccgcctcttgccctgccctcgctgctacgggatcctgacctgcagcaagtactgcaagaccaaggcctggaccgagttccacaagaaggactgcggggacctggtggccatcgtgacacaactggagcaagtttccaggaggagagaagaattccagtgaagcagcagctgcacgtccgaggcttggggaggaccaggactgtgtgggtttcttacctgcctgaccacctnaaggaatcttccacctaatgcaagcttttttgcancttttggggtcatgctttttancaagnntctcccttgcgaacctnccnataaaatttggccccaccggggnngatttttacaaaaaaaaaaaaaaaaaaaactncnnccctttaaaanttnttnggnggccttttcccccnattccccnccctttaaanaaancactnntgnnngnttn

SEQ ID NO: 2240 - DNA, 738 bp, Homo sapiens
  misc_feature (1)...(738): n = A,T,C or G
cacctcgntcgaatcggccgaggtttagaaactgattctagacatttaagttcccagactaatgtcacagaagctaatgaattgcagaggttaattggaagcctggtcttaacactcccaggttatcttaatgagttcatgaggatggcatatggataatgcacttcaaagggtgttgtaagtattaactaagttaatacaggtcaaatgcatatattagcactcaatgcacggccattgatcaataaatgctagtggttctgatcagtgagaatctaacctctgcttaaatacctttagtcatcagcagcttccactccctgagtaacatgttgcatttcttgatcaattatatttttacagaattcttcctttactgaagttgaaatcgtctccttgaaatttctacttggtatggcctctctgtttgctacacaaataaatttaatcctaattttatctancttattttccaagcataaccacaccaatttcattaaatgattcctcatgttggcatgacttaaactccggtcaccatcctatttgnttttcncaaagagcttccagttngactgctnctgtgaaaatgtccatctattaatggaaatggntttttctaaaatttacaagancttccccgttgtattgnggtacaagggttaaaaanagttttctggagaattcctttgactctnttttncccaaagtttnttgnggggncctttctcttttcct

SEQ ID NO: 2241 - DNA, 721 bp, Homo sapiens
  misc_feature (1)...(721): n = A,T,C or G
caccncgttcgantcggccgaggtattcagtaagtaccaactatggtgctaacgtgagttcgatacgaaaaaagctgagattcatctatatccattttagaggaaagaagtgctatgacctttccaaactttcatttctctatcccaaagtctcatctaaacagattttactactttatgatctatgtttaaagtccttgggataaaaagaacaaacccaagaatgaggagtcttacttctacacttttatgatttcttatattggcattagacataaacatgtctgagaggctgtctggtccaactgtctctggtcacttcgatcttccaactgccaactcccaggccatgggatcacttcctcctctaaattctacctactttttataccattcaactggaaatttaccccacacaagatttttggcatccctcagatattgttatataactggaaaagggcaggaaatgtggattataattttttgcaataccgggagtggcatacatggagctttgcaccattgctgataattgatacacatctgattaatgtataaattaaccaaacagtactgactctcaagttttcagaagtgtangagtctctaaatgggtctgaagataccatagatgaaactttcattnacactgccaatcgaaaaaaaaaagccattgccaacataatccaatttttcctcaaaagattttggnaatttn

SEQ ID NO: 2242 - DNA, 743 bp, Homo sapiens
  misc_feature (1)...(743): n = A,T,C or G
nccnccgancgnttacgtgangnatnacttactgtggaattgcattncaaactgggctgaggtgggatggtggtggtagataagaggccagctctttatttcaagccaatacatgttgcaggctatggacacaaattcatatgaacctgttagaatgcanaatagccccatgttaaactgtaaacaccttatcntcatcaccattcatataaattagttgatttcatattttgcgtntgctttgtgaatgagaaaacctgatacttagcatcatcttccctaaatacagtcctgaccaancaaataacagaaaagccttctacagtanatattttgttttttagaatntatcattnacntntttaatttaatgctncaanatagatnatacacgtccncnaatttgaangncnaaacaatgtaaaanggtatatgcagagaagtcttattcttacccatgttggtaaattatatattgnngaccccacctaccccacccaggtaactatatttattagttntcatttattccttccngcggtttgtttattgccaaattttanntaaaagatnaatttntttgntcataatntctgnctttttctttantagaaaggnagtatactatttacntcggtctgcnnttttttnttcgttgncgnnggtttnttggtttttgncttttgnccctttggagnaagggantcttggttttgtctttcagcctggactgccatggcccc

SEQ ID NO: 2243 - DNA, 773 bp, Homo sapiens
  misc_feature (1)...(773): n = A,T,C or G
accncgnctcgantcgcacganggatgctgagatgatagtccttttgaccaggatgtctcaagtatccaagcccanaaatcatctcttctaggctgaatcaagatggtttgcataagagaccatgcagatgcacgtctctgctatcttacattaaaaatgcagaatggctcacctgccctttgttgtcatatgttatatagaaaaacctatttgcatgagaactgtcacccacagttttgggtagggtcagtgtgtgccactgagcaggaacgccgagggccataacctgtctaatgtattaaattctcaggaatcgggattaaaagttaaccagccagcatcctttgctataaggttgaatggcgcaaaaggcaagattgatgcaaaggtgcacagcccctctggagccgtggaggagtgccacgtgtctgagctggagccaggtgancaggaagcctgctggggggtcccagcaccagcacttttcagcanaatgttcctgtaaatgtgtgtcccaaggggagggctgatcaatttcattactggcagtgaagcctttgnaattcccttttnntggtgccanaatattngttattnaaattaangggtttnaaaacatntgcccaaggggataagggganaaaccccttttatgccttanggaaaaaaaaaggcccaattcccttcctttcctttttntaaaacaaaatggcnttgggctttgggtccanctggccctttaacccttganaaggntcnaagncntncanna

SEQ ID NO: 2244 - DNA, 722 bp, Homo sapiens
  misc_feature (1)...(722): n = A,T,C or G
accncgntcgaattcggcacgaggctgggtgcatgtgctaccacacccaattatgaatttcatcattagtttcttagtagagtccacatgtcctcagtagtaagttcatcagtgctaaatatttgaaggtatttctactgttttgtaaaagtaacttaagcctacctggtctgctatcttttgagtatttatactttctacgggcttgtaggtaaacataaaaagagaaaaaatatcccaataatacagtttttaaccttttatgataaagacatgcttagaattgctgttaagccttctgagatttaaccactgaaactaagtaaaagacaaagcacttaggtaaagcttcattcagtatccattcacccaatactggtttgattctagggcctaggaaaataggactgagcaaagcccttgtccagatggaacttatgttttagaggggaaaacaaaccataaaaaggtaaacagtataaaatcaggaaaggataaatgtatatgaagaatcaaaatgaggacngtgatgggggataagaagggaangtttttgaggagagcagagcaatgatgtaaaagccagacacacagataggggaatagctttcctactaangggatgggaaataaaagctgagntttggcttgaggcctccaacattganaattgctanaactntgggaacaaggntanagnggaaanattttagccaagntcn

SEQ ID NO: 2245 - DNA, 746 bp, Homo sapiens
  misc_feature (1)...(746): n = A,T,C or G
accncgntcgaattcggcacgagggtggagggaggcagccggcatggcatggtgaggaagggccatggaagaggacagaacctgtccacggagtcaatgctgaggaaggaagacggaggatgaggccagtcaggtttttcgtggtggcagtgccttatgtttttatcgaagtgtatattcacacagaaaagcacatctcccaggatcctgagagagcttgaaccagaccactgtggacacggtggccacccgtcaccactacccttcccaaggggagacgaggagcaagtaggcttgagggaaaagctgcacaggactcgtgtcttgaaatgtctaagacgcatgtcagaaatgcaggtaagggggggtgcgggtgctcgcacctgtgatcccagcactttgggaggctgaggcaggaggatcacttgagcccaggagttcaagactggcctggacaatataacgaggcctcatctctataaaaaaaattaaaaattagctgtgccccaggtgtgttggctcacacctgtaatcctggcactttgggaggccaangcaggtggatcacctgaggtcangaattcaagaacagccttgcccaacatngaagaaactgcattttctactaaaaaataccaaaantagaccgggcgttggtggtgcatgccctgtaatnccaacttcctaagggaatcttgaggcaggganaaatcactttggaacccnngnaggccggnaggtttcnc

SEQ ID NO: 2246 - DNA, 844 bp, Homo sapiens
  misc_feature (1)...(844): n = A,T,C or G
accncgntcgaattcggcacgagagggacttcgttgtaatgggttttgctgtaagtctaatggcaagatcaccattagcaaatggaaattacatttgaaagccattaggcctctagaactatagtgagtcgtattacgtagatccagacatgataagatacattgatgagtttggacaaaccacaactngaatagtctgcctcacnaagccgctttctcggcnactancncgccgcncgccnangnnagnntcccattntnccccnngttncccacatttccctgaattaanngcnatttncttatncagaattgcacttnnagnagcannngganccncnggcgtctnnccngctacntngtggannnctgccnctctccnaaaccgggctttaccnccccgnggccccccttcccttttctcntttaccngnnntcccccnnctttgatngnanccccttggtacntcnccaagntgttggcnccnnaccaattggancccncanngtcgcaccnntnncnctngcantttttgacccacttcntattnnaaccccacgttcccttnntngncccccgcganananccccgctnncngggncattcttccccanggttggccnannaaaaccccntnngcccnnntcggccntggntncgcggtctaactnttntcnnnaatanntcccctnttnnggncancttgccaancccnctctccnttgtccnggttccatttnccnctcggnnnnnatctcccanacatttggcnnncnttctcngaanagctctcncacactctcntaccgcctttaatcncctanncaacnnnagcccctnnt

SEQ ID NO: 2247 - DNA, 750 bp, Homo sapiens
  misc_feature (1)...(750): n = A,T,C or G
accnncgntcgantcggcacgaggtccattcttataaagggaacttctagcaaacctgcccagccctttccctggagggaaacattatctgtattatcctaaagagcaaacaaatctgctcttggttccaaatagagacactttatctttcaagacaatgcctatgcaaatatcttagaaaagatagtctaggagaaacaagctgccacaagaactgcaaaaatgcaaacagcctataaagaattgtctcccaacatattgatcttttatattattctctttatgcgttgtcataaaaagttgagagactgcaatcctgcacctgaaatcctcatttcccttcttttcagtgttctttatctgatttttcaaaattcatatactatttgtacagtttctattgaacctcacctgaattccagttttatttactatgttaaatgattcattcaacagctatttactgagtatatattgaagagatagctgaactcccatgtttgttgcagcacaggtcatgatagccaagatttggaagcaacctatgtgtctatcagcagatgaatggataaaaaaaatgttgtacatatacacacaaaggtacgattcagtggatcaaaatgaaatggagatcttgtcatttgcaaccaacataagaatgggaatgggaagtcattatgttaaagngaaataagccnggccccagaaaggacaaaccattggcattaattcttcnctttattcatnggg

SEQ ID NO: 2248 - DNA, 1400 bp, Homo sapiens
  misc_feature (1)...(1400): n = A,T,C or G
nnaaaaaaaaaanccgnnttgaatcgncnaaaaattaatggtttggnantngnagangantaanngaatttacatttttaatcgtatngtttganatggtttaanngggcgggggaagnatatngnntaattggaggatcccnaccaaacactnttcgngatgtaaggggngttgagaaaatactantganatggntanctataacgaaacatacattcatcccncctatctgttgtnantatagtaacatgnanatatcatanggggggggggggggggagttntctntntnntcgannctnaataggttcgtacgnttntagtggtntccatatacntgcananatnatcnttngtganntatgtncgngnaccatataagtnacatntcnntcacgantattattngagngtccncnnattacntangcgcnnnnaccnngnncnntagtaaatcnanacacannngcgtgcncnanngtnannnaaatgtagnnncgtgtgaantnncgccnangaaannaggnnnnantannnntatnnananannnanngntattgatgngatgattannatttantcnaantncacgnnnattntntangnnnncnnntgnngttnncatnnncccaccncngntgannnnaagnnngnacatngccnatgtnnnttcnangtngangataatnatngcntncncnnaattannngntgacnncnannccnacctgtttncnccgaagtgncgannnatatnnaccncnnttttatacancatngcccnnnnttgcccnagtatnanantatncanntgntgnggatgngnggannatgccnntntntaggcnnntatnnntnnntnaantntatncggnacacnnacgcatntntatatncnangtncnctnnnatatgnnataagantgncatntngtatcnntgnctaaatatacgaccagcanatnttgtctntntcactnacatntatcatagacgatgnntnntnaatatnggcntctatgantatnncnggcnnnncatatatattattgatcgcgntccnnctacnnagatatctatcgcgagntcaccagtgtctncnngaanattacatgcncncgncntcgtntannagttnatgcgtntatgtgagncgtncgacctcncgtgcnatntannganagancgntagtctnantatgtagtcanagtatatatcgtcgagntaggagcggaatatatgtanananacgctntntataggaanntcggtatncnncntnanatntcnacaacnnacaanttnctaangnatattctttcatgataatctngaatcgttaattatnntannanngnacancactaaatgatantangatnaannncgtaccnagn

SEQ ID NO: 2249 - DNA, 1045 bp, Homo sapiens
  misc_feature (1)...(1045): n = A,T,C or G
ggggggggttgntanacganacgagcaagtcnctaattnttttttnaccnnntnantattatcacnntnccnttgnntaagaaaatntantantcaaacnttttcntcancancgggttatagccntctttatnnggggtnntcttnntgcaccnataaaacangcttttttgtccantaanttttttttgtggngcntcttacngcgnnctgtnttggnccccanttanangncccnnccggggtatnnattatnanantantncntttttttngaanatcncntatnngnnaaagagaaagncntnattatctannananggncgnggganaacaaannggatgcnanattttgnncttnatttggtntnngnngcnttannntcggnnanagtgggcccgcnataacaagntatcanaatgccccgggaaccctnnntangtnntnttntaaaaganaatnngtcccncccngaaaaanaatacanantttgtgcctgagagggntaaattaaaccnctcatcntttcatacttaancaaanatantattcnnntaatnttntgcngccgggcnnntntataaatnanttttcacncacanactggtgcggggcgcaacaacannngggnancccactcnttattnaatcgntccatggganttgtgnaaaanttttanttgcgnnacataataaaaagtgnctatataatganncgctantgatagaatccggcgcgntttcaatantatatggtngccgatgtnncnaaaanatatngagaagnatntacnaggngtgggcccnnnaaaagggttnttanannnatantcttgtncaccnnatatnttcnncctggannaaaattattcnatngggcatacnntcgtttatacnccactggggttnaaaagaaaaatanttgacgntngtannnggccaaaaacnagagnntntttntngggggggggaangtgggcataanaanacnaatttttttcttttgttctnnacccaaanatacnggggggtnttaaannnat

SEQ ID NO: 2250 - DNA, 735 bp, Homo sapiens
  misc_feature (1)...(735): n = A,T,C or G
accnncgntcgantcggcacgagatcatgctgctagtgttcccgctactagtgctccgttagttttaaatcatgttccaacttgaatttgaggtcttttgactttcgttggctttttgtcagggaaaaaaacctgttagggacagggtttcacaattccttttatatttccattcacatgtatttacaaacgtgtgcctggagtagtaagtacacaataagtgagtttccagctgtttttgtttcggaaacaaaaaaaacaaaacaaaacaaaacaaaaaaacaacggaaggtgaatggaattgtgtttgtaacattaaactgatgtttgaaaagtagttgggaaaaaaagcttaggtactaaggagggttcatccaacttttttttaaacgaaggacgtgttgccttagttcaagtttgtataaggtgctatttaatatgtattgaagacttaactagagcttacttatgaaaactgaaaataggggccgggtgcgttcacgcctgtgatccagcattttaggaggttgaggcgggtggatcacaaggtcaggagttcgagaccagcctgtccaatatggtgaaaccaggtctctactgaaaatccaaaaattaaacgggcgtaatggcangcgcctgtaattcccacttaatcngggangctgangcaacaanaaatcgctttgaacccnggaggcanaaggttncatgggcccnattttggcccttgcanna

SEQ ID NO: 2251 - DNA, 1047 bp, Homo sapiens
  misc_feature (1)...(1047): n = A,T,C or G
tttttttttngaattntgnngnggntctntaatnncccnggcgtnnncggcnagnnaacttgtataccancnnnttttncntcttntatgtnctgntnttgttngaancctgcanattgctngggggtnacttnttnantaaataaacncctttaccatggatttccntnatantnnntttngngtcanattagcnnattcncncnnacncctntttanntcncggctnngtattnttanantnnngtnggnggngttaaaaataanatgacgggnttttntccntanttannngtantgtanngngccgtgncancnttntttatcnnantttgntncntttttatancccnnttctcnnatgnagnatattggccancgaaatttaancctcttnttatntanccnncnttnttatataaattggnntttttataatnntttanaagtnancntngnggtttatatntntgttanaaangnggnntttnatnttaanncaacggcttgttcncgnngnggttnagcnccaanttnannnttcnnnttngtatatntannnntattttgttnanncccacctgcatccttttatacncatcnntttatagnntgcnnatatanggctattagagcacgtnnatntagtttnttnccnnccanccattnttntcccgctngtnttgnnnctnaccgcntnatgttntncccntcattantantncccnntcnttgtatttngnntnnnattnattttantcgtggcncnattgttactntgtgnggntaanaanaggntctntntgggttggatanttaaagncaggcacaaatgnataanttntnggnntgtgnaatttatnttttcnggggggctttatnngntcttngattntgcgtnccccttttnntnaaacccgnggggggnggaaaaaaacttnttagngntncaangtnannaantntctnggnaacnaaaagnaaattnngnaaatttttttngngnntaaaaactggcaatttnggnatttnnannantgaggctan

SEQ ID NO: 2252 - DNA, 719 bp, Homo sapiens
  misc_feature (1)...(719): n = A,T,C or G
acctcgntcgttttagtccagtggcttgtaattaagtcatttttagtctttaattatgttggttgcttttagaattctcttttagagttggtctacatccttttaaaacatgggcaatccaaatttataacagtaaattaagatacataaaaaaaaacactggctaaatttaaaaggaaacacttctagaatatactgtattttgacacaagaccagactgtgctatgtgtatgtggtgtttcaagtaatttaagaaaactgttggaattttctgtatttccagtttcacaagaaacaacctcaaggagggcagtttaactgaaaattcagaggtattatagctctgaagaaaaatactgatgagcagttatacaaaatgagaaattgagttctaagaaatgcatccctaacttcaacataaagatagctatgagaaaacattctttgtcccaaccataaatgaataaaaatcacctcatttctcatcagatgtttactgggttgctagttatatatagaatcctgcaagaagctcaacagggaagtccaaagagtcaatcaagaaggtatgataatggctaaagatggggactgnangtcaatgctccacgaagtcttcttttgtgcccaatatagctgcactggtatcccatatgggtacaatccagcctcanaaaatgtgcagatgccctcccagaagntgagacccagttctcat

SEQ ID NO: 2253 - DNA, 738 bp, Homo sapiens
  misc_feature (1)...(738): n = A,T,C or G
cnaccncgntcgccttttagtaacacaaagttccaagtatgttacctagtttacagagtggtactcaagaagagaattaacattcttactgtaaaacttcattgataacaatagtctacttctagaaacagaaataagaattaaaaacagtgctatctatttgtactggtgagtgaattttaacttttaagaaaattttaatgtttaagaagaacttcagtgtatggagttacaagctatcctgaatatttttataatagaaagtattagttttcccagtgtggcagcttcttaataaaagaaattattcccttaaatttgttctttctctaattagagcagtgtaaagtaccatgcagaagtttcaggatctcatacaaccaagtaaatagggtttttatccccctacccagaaggtcccatgtagataatgaaagattgtatttgccattctgtgaaaattgctttaagcccatcaaatgcntaccctgctttttaatcttaacagcctccacttatattttaaaaacccattcctttctttctttccttcttttttctggagacaanggcttgctctgtgggcccaactngagtgcantggnggccatnaacactnactggnagnctcnanctngtnggngttaagtggatccttccgaccctcagccnnctngagtanctggggactacnaggnggggcnanaaatgcaacctggggttgggtnggtttggtta

SEQ ID NO: 2254 - DNA, 752 bp, Homo sapiens
  misc_feature (1)...(752): n = A,T,C or G
gacctcgntctccgccccacctggtgaacgggcccggccaccaccaccatccactctgctgcggccacataacccacctggcccagtacccatggcccctcgaccccgagttcgggcccagccttctggacccagccagccccacgtgtgtggcttctgtgggaaggagttcccccggagctcagatctggtcaaacacaggcgtacacacacgggggagaagccatacaagtgtgcagagtgtggcaagggttttggtgacagttctgcccgcatcaagcaccagcgtgggcacctggtcctgacgccctttgggataggggatggtagggcaaggcccctcaagcaggaggcagcaacaggactggaatgacgcggtccagggagggcggaggcccaggagaccaaagggaggggctctgccgcttagcagagaagaaagggcctgggaggtggtgggaggganaaagaaaggaanaanggggaggaagaatanatanaaatanggattggagacagtaaccctttaaagctcaagaaacttgtccttgcttgggcttgagttaaggaccttngcaaggaccggcntttaccccttggcttcttnaaanactnnctaaccacacaatnaggcatttcaattactttgttgaataaaataaaacttggcttttccccttncnnacaaanannttnctcctncnntncncccnccnnnnnccccannctccccccccttnaaaaantttana

SEQ ID NO: 2255 - DNA, 1369 bp, Homo sapiens
  misc_feature (1)...(1369): n = A,T,C or G
atttttttcnctnataaaatcgagtgnaatacttgtnaancctttatantnantttatcnnctgacgnccgcgccttgcgtatatatttntgatgatgagatggacttgattggagntgcatgtatanctnctctctntcattantnttnancacacancggtgtgtgtanttnnnntgngnatctntgntntngggngggggggnaattgtntttancagtaatannantnttagttgtcnntcacacttagngtgacgantatattntatntatannacagcnnttnttgngcnacttangccncannncantnngntgncccnanncnagttnntantacatcaccaccataangcggntnannnaanatnccncgtngcancntntattacnntagtnantgcccangtncnntatnannnacnnnatcgtgnannnttaanncnngttttatatacntcnctancnatgtngnnntatgngtacnncncattnnnngnncttannggaaantnnntntataacagtgncnngcntnnnnncnnntntgaacatatanntngngctatatancncccnnntcnnnatnnntgtngntgtancannnantanatnntaatacgacnctcanacgaacngnagtggaganaagctanganannnngtanttgtatacanncntannantgangactnatttnactagnatnattnnctnnncttatctnntganatntccncacncgtnantaattancaaacncgtnntgtgnancantnngatnntgnagaggnntncgncgngtnaacnanncnatatncccccctntttnantaccnntgcgttngagngtngttngttncacnaccnccgattntganacgngnggactgattagtggngacacacanagagnatanntntctnngcantacaaancgcgttaatntctcacgncgncnaacncgtgatcgagtgtnacgantagaccgtntgtgctnaancgagtgngatgcggntnactcatangtntntcngatgacatnttgtgcnaaatggagttgagccatatgtaanatntaaccacgccccnatgggtaaaaggaatngnnntntcnncggngtaggattgnactcgccatcgaagntatntgacatcgtgtntgtnacnanatnntcatcngatattagacgctnnatcancgngnggaaacgnngacnanannacgaanaanatncccccctngagtatngnccgtaaagacgtatatntgaccgnacntnangggnagcatttgtatacanntncccccncnacacatanggcgctntgtattatanttagctntanacnngtaatagcgg

SEQ ID NO: 2256 - DNA, 908 bp, Homo sapiens
  misc_feature (1)...(908): n = A,T,C or G
nctaatcctttgnaactncttgttctttttgcaggatccctnnnnncnaattnnnnnntntgagccatgcgagcagctcgtttttttggagaaagaactgtaacagaactgatttttcngcaccagaaccctcagcagttgtctgccaatctatgggccgctgacagggctcgaggatgccagtttttagggccagctatgcaagaagaggcctngaagctggtgttactggcattagaanatggntctgccctcncaaggaaagntctggtactnttngttgtgcanagactagaaccaagatttncctcaggcatcaaaaacaagtattggncatgtngtgcaaccactgtatcgancttctttgttttaaggttaccaaaaanagatgaanactcttccctaatgcagctgaaggaggaatttcngagttaatgangcattacgcanagaacatgatgcccaaattgttcatattggccatgngaagcngggactcccgtattttcaccctgaacagcgggtccttctcntttggtatgggggacnttgnnctcataaaatcacacaatngccgcttttatcattgcataaanggtntgtgaaaatttagaagaagnccngaaggttcctatcattcggcntggtnacnattcgaaagaagtaattaananatatttcntanaagnaagttcttattaccnccaaaanccagctcgggaagaanttccctnatgntttttttaaaaatgncnannaacttctnttattnaaatataatcccnntantctcccctctttaatttttnctacccttggccaaaaaattaaaanggggntggccaacnggggggaacccannntnntnanacaaaanatcnnnttnattcctccaccccttttaaaaa

SEQ ID NO: 2257 - DNA, 757 bp, Homo sapiens
  misc_feature (1)...(757): n = A,T,C or G
ttanncnnnnctnngctngctgcctgcaggncgactntnnangatnnnnnnnnnccgagctcgaattcgccctatagtgagtcgtattacaattcactggcccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttaatgctttacggcacctcgaccccaaaaaacttgattagggtgatggtcacgtagtgggccatcgcctgatagacggttttcgcctttgacgttggagtccacgttctttaatagtggactcttggtccaaactggaacaacactcaacctatctcggctattcttttgatttataagggattttgccganttcggctattggttaaaaatgactgattaacaaaattaacgcgaatttacaaatatnacgcttacaattnctgatgcggatttctcctaccattgncggatttacacggantgggcactctaatacaattgntn

SEQ ID NO: 2258 - DNA, 794 bp, Homo sapiens
  misc_feature (1)...(794): n = A,T,C or G
ctgatnctatcagctcttgttctttttgcangannnntnnnntcgccctnnnaaactgaagaaaattctaaacgaaatggcaaaaagaaaattcatttttttctctctgctctgaagaacccttgttataacgtgtttatagcatctttggtagatggagagagatcttttatgacaaagagtgtgatacaatttttttaatgcatatagggcattgttcttcctagagcatatttacataaattatctcatttggaaaacacaacaaccttatacttgtgtctgcattcgcttgtgcattttaaaggtcggaagaaattgaatcttttcaagagtctttctgagaagtcagtaactttcagaatacatgtcttacctttaaagatgatgttacggatggtaacgtgtgaggcttcattgtgaaatttaattgtgataaaccagtttaatttccttcagcatctctttcagggctacctgaaagagccatgagtaggctcttgatctgatgcagtgtacagtttttaatccaagggttatatcaataatccagcatatgtttaatgaataaatctatgttccactggtgtggacacctggctctgtgtggtcattttatttagactttaccagcccgtgagaaaattcatgtctatgtctcaggacaagatgtgtaatcaaaggtaggaacctgtgctgagaataagaatacnaggtctaaaaatgtttatttttgaatggaagagaagaatccaaatgtaatttggatgggccnaggcaccggnggctcncan

SEQ ID NO: 2259 - DNA, 1048 bp, Homo sapiens
  misc_feature (1)...(1048): n = A,T,C or G
cgttgatcctttcaagctcnngttctttttgcaggatccctcgattccccctaccgaacnggaaaaaaatctnaaccnnanggggcatanaaaaancnnntttttnncncncgngctgnnaaancccntgggntaaccgngtntatccntntngggngnngggaaananacttttggccaanangggggaccanttttttnatgnctnntngggcntggtcctccctaaaccntnttccntaattnatctcnttnggaaaccncaccacccttntcctggggtcngcatcccctggnccatttnaagggccgggaagaaaattgganncnnnnnacncagcctttctggnnaagtcnngtaaccttttcaagaaatccatggtcttancctttaaaaggaatgaatgggttncnggatgggnnaaccggtggtggaagggcctttcatttnggggaaaaaatttaaaatttggnggaatnaaaaaccccgggttttnaaaattttncccctttcangccanttcttcttttttccaagggggcccttanccccttgggaaaaaagggaaagccccccttggganggtttagggggcccttcctttggggnaanccntngggaatggnccnaagtngggtaaaccccaaggntttttttttnaaaaatncccccaangggggggtttttanttatttcccnaattnaaaatttccccccagncccatttattnggttttttaaaaangggnaaaatnaaaaaattccttattggggnttnccccccctggggttngggggggggancccncccctnggggccttccttgggngggnggggggcccaattttttttaanttttaagnacccttttttaccccnagcccccggnggaagnaaaaaaaaatcccaanggggccttaattgggccctnccangggaaccaaaggnaatgggnggttnaaattcccaaaaaggttaaggggaagcccttgggnggncccttggngggaaaattaaaggaaanttcccccggggtctttaaaaan

SEQ ID NO: 2260 - DNA, 978 bp, Homo sapiens
  misc_feature (1)...(978): n = A,T,C or G
ntntnatcctttgcaacnctggctctttttgcnggatcccatccgattcnaattcggcacgaggcacctgtagtcccanctactnttttngttgaggcaagaaaaataanttgaacccagaaggcnaaggttgaantgactngatntnaccccaatggcanttancagcctgggncanaaaggaancgnaaattttgctaaaaaaaaaaaaatnaatngggctttctttcantcctcttggattcacattctcttnggtaaaaaaagctttaaancntctttttccgggggttcccggggtttggggcccgttccccggtgggaaatttcttggggtngggnncttggccttgggggggtcttcttgggaaaaatggttggcnttgcnngnccagnngnnncnctanaaaacccctggaacaattgccaagttttttccccntngccttgaanggggggcccccttaangggggangttcaacaacccaaaagggggtccccccaacgaangaaaaaagttttgttgggccaattnccccccggggggggccccgggaaaaaaaaaaancccccccggtggtcttttcttggaagggaagtttccgtncccttttgtngtncccccttgccaaaaacatttttnttctttgccgnaacctttttgncccttccaaaccaattggtaattggtaacctttttcccttggcaagccctggtaaaaaaacgccctctttaaccnggtttaaantnattgttggtttccgcttttgcttnaaannaantattaaaccatnnngcccaggcccgaaggttgggggcaaccnccttgttaatnccaaacantttttgggaaggcttnaaaggtngggaangaatcaactttggggncccaagggggttgcaaagaaacaanccttgggcnaacaattaaccgaagaacccccattgtnttaaaaaaaattntttttaaatttan

SEQ ID NO: 2261 - DNA, 906 bp, Homo sapiens
  misc_feature (1)...(906): n = A,T,C or G
ncnaaacctttgnaactncntgntctttttgcaggatnnnntnnnnnangaantcgnnnncgaggctgctcaaggattgcagggatttntgcaagtggaacagccctcggnaacctccnnttttgngcacgctccaggtcccagtttctatggcaaccataccggcaaattgggctccgcaatggttcctcctggaaaaaccgcgattttggttcccgcggacgtctctatggnttcgacagccnaaaangaacaaaacggcatttccgggaagatggcggngcacaagtcaggtccggcacatgtttccncggagcggacccagcaatgacggtaaggggctcccttcccccgaacggtggnagtcggagcccgggcttattagcaaaccgtgagangagcagagtattnttacccaaccggcactggngtagganggctggaatttagccctcaaanagcaaggaacccnaggaaagggcaancccggctctttanggactcgctgtnaanacgaanntgnacctggggccaccttctgaaaaacancagattgnactgnncaagggggaccagtgccccgaaactgtgaantcacnanggtttcaanaaaagacctgggggccgccacaagcntttntttnccccaagtttatcccncccngaaaaaattccccgntaaaaaggcccatttcncttaaanctatatgccccaanttcannctttaaaacaanaananaaccaaattgganatnggtntttcctggaactttctgggccccccgccttaccgtgccttcgggantggngcgggaaataaaaaacccgggcctcttnaaactttcaangggcaatggtnanatttccaaattnaatgccaaaaaagggnttnnngcccgcctttc

SEQ ID NO: 2262 - DNA, 808 bp, Homo sapiens
  misc_feature (1)...(808): n = A,T,C or G
acccatnnnnncgnnaannnnnnnaccaaaggaaancnctaagccattttctctgccctctagaagcttataatgtactttcctatnacanagcnnaataaaaacatgaaacctataaatgggaatgccataaagtattttnatctctacaggnccatccatgcagagggcatntattgggtgactgcagtactgcaaaaggttgcaaaggaaatggaagatctggtccctgtaggttgggagtttacaatctaattagaaatacaaggcatatataccgngaaaaaactagaatccccagctgtaagcaaaaggatggagtaggtgggagcatttttttcataaagagagcnttgtcctgnatgattggtgaggacagganaagcaagttcagtaccaatcaaggcaagagcacctatatgtatccctgctctatagaatgatgtaacanggccctcattgtcacttggctgaaagtgtcagctctgccaccttacaaacctggttttgaacctgnggcacatttttaacctaagaaagggaatacaggtttgnctccgtgaaggnggttggncnagttccaaatgaaaattaccaaaccgtgaaaacctcggtgaaagcttcaaatgaatgtccnatnccatnggagtccctcaattgtaccaaactggcccctttctgggtaanccttnaaagttcccttccccaagcctntaaacctggnaaaaagggcanggacccaaggccccgattggnatccntcaatgtttcncnaacngnttaaccaaaaggngttcnntntngggnn

SEQ ID NO: 2263 - DNA, 976 bp, Homo sapiens
  misc_feature (1)...(976): n = A,T,C or G
gncnntttgaaaccntttncaactncntgctcttttgcnggatcccccnatncctnttcgnntanngggggggaacctanntggctcccccnccggctttnttttcccntnatggancaattggaaggaaaccnnntaccnntnttccnaagggcccagcaacctgnanccctntcatgcctnaatggtctggggttttgccccnaccnganangtttttccngcagaaaagaacccnttggggagccancattagccccaangatggaccaaaaccacctggggcctgcccttggntccttgccccctcccttgctttactncattattgccaaaaaaccccaantgggcccatttgtngnccccntnanattnccaaacctaccccagggggagcnttgncctggccanngcnnnnnnngnttttantaaaaaaccccaaagtgnccttnccnccngggaaaaaaaatcttgtgggcctttgggcccccanagangaaacccaagtggggaanaaatggtgggggttntnccttgtgggggggatntcggagcactcccaagtcccccaattgcccccagtcccccttcttctttncangtggggaagctcacttgtctttccccagcagccacctgnccttcttccttcttctaaccattccctctttctttgcttctttccgccccggttccttcacttaagcccgttttatttggggggtccattcaagcttnnccanccccntgggccttcccaagtccattcgttncccacantagggggattccaaccccnaaccgggtttcccattgcccggcnttcgcccnccaannttttcaaggtnccccnaggcccggattcnanggaccccanccaangcccactngggcccttaccagnngcccctttccattncccnggggganttttaattcccccccccccttcnntaagganccacctcttngcccg

SEQ ID NO: 2264 - DNA, 755 bp, Homo sapiens
  misc_feature (1)...(755): n = A,T,C or G
ncgagatannnnaggacctagaggcttcccaccagcacagtagccctaatgagcaattgaagaaaccagtaaccgtgtccaaaggcacagcaactgagcctctcatgctaatgtctgtgttttgccaaacagagagttttccagcagaaagaacccatgggagcaacatagccaagatgacaaacactgggctgcctggtcctgccactcctgcttactcatatgcaaaaaccaatggccattgtgacccagagatacaaactaccagggagctgactgcaggcaacaatgtagaaaaccaagtgcctccacgggaaaaatctgtggcattggcccaagagaaaccagtggagaatggtgggtgtcctgtggggattgagactccagtcccaatgcccagtcccctctcttccagtgggagctcactgtctcccagcagcactgctnctcctctctaacatcctctccttgctcttcgccggtactcactaagcgtttattggggtcatcaagctagcagccctggctccagtcatcgtaccaagtagggatcaaccaacggttccatgcagctcgccacaaatttcagtcccaagcagatcaggaccacaagccagtggcctcagagccctccttccagggatttattcccccacccttataaacaacttctgccgccaagcagcttggcccgaaacacaagtcacttaaggggctctccaanattcactaacccaacnagggcccattcaagn

SEQ ID NO: 2265 - DNA, 1147 bp, Homo sapiens
  misc_feature (1)...(1147): n = A,T,C or G
gnagccangaaccctttgggaaaanncccccggnnnnnntttannaaannaaaannnnnnnnnnnnnnganagagnnaaagggnnaggagggcgcnnaaagnnggccnacnaagaccanaattttttttntcacccaaacgcnganncaaaaagagcncnnccagggggggattcgnantnagcaanacacgcaaggggtggacccttttntataaaaaaccncgaancanaacgccacgnggngncnngaaaanganacgngcccacncncnnananngagnngcccacgnncccnaatnncagncnncgggaccgacccagccaanganccnncncnngnaaccccccnganncnccccgaannncgaaannacnnggccacaacaagaccnanngnagcagcganncangccccaagnggcncnaacncnccaaaccnccccacnacnccngaccnnnnaacccncancnaaaaanagcccnacnngnggaccccaannacccacacccagacaancncacaanncacggccccacgtccccgncncaagnncngnncccnccnagccnnngnccccnnaancancnaanagaccccnanccncnccacnaaggaaacgnncnngancccnaaagcncaaacngnaacacacacccnaccnngcgncncgggtnagcanaccnncncccncgcaccncacaagagtaccgcaagcgnanngnnanacngacanccagcaaanccnaacnnngccccccnnagaaaagncngacncncacccaagnnncanccgacaacngnnanacccccnnncgacaacgacanccgcccacagcaannncnagcganccaccnaaagcnnnngnnacggngncaaaaaacancgngngcnacacnngatntagcaaacaancccaaaggnncaccnccgacgagaccacnangnacagangcagcgannnccnnccccgnagngnccnaaagcnacnnangccngaaacgcggnagggnnngngcanggcacgncccganncaacacacgaccccanagnacgcnagnnngncncnngcngancacnnnacccanccacannggggcgagcgncgagccagcgacgagtagncnacaaacgnccnnccggcn

SEQ ID NO: 2266 - DNA, 992 bp, Homo sapiens
  misc_feature (1)...(992): n = A,T,C or G
tcgtgaccctttgcaanctcctngnncttttngcaggaancnnnnnnnnnnngnangtnnggnnnagaggaaaaaaaccantnnaatagaaannttataggctcccgcctcaggnaancngggctggnntttaattaaggaanaaagccgattctactgactgacgtatccccctgctgntaanaatcccaaccacacactttcacacactattccaggttctggccctgaatgacccncagctgangatnatttgncatcncnccacttctntttttancancnccaaanancatttccaaanaaaacgtttttagctttttaacngcgattcaccactaagaaantggcncngngaacagtccacagagcttattcaaattncacccattctacatgcacncntttggtgncgcctgtgannatntannctnnatcncatttttancaccctgcgnagaacggnannaaaancnggnaaacntacagccaaganaccagtagccnggctccggccatcacnnnagnctttgcccataccnatccctnttanaggaccatntttntaccntctngcncnccccanttccttaanccnntgggaaaccnaactnaaactggnnccntncaanaaatcnttttttantttcnaaagaantctttaccnttaaaatncnggantcncgnaaangntttnaacccttcctggnnaaaangggccctncntccacntcccaatnttccaccnttgcangaanaacnaaccnanaggctnatacnctnccaattggntatatntaantntnagcnataaancccncccccnttttatactcnggntannancacaagntacnctnttccnntaaggntnangccnaaacattaccctanagggncacanctaangnacntattcttcccgccnaatgcgccataaaaacccctctccccccnttgggaaacnnatacttnggggcnggntnttcccg

SEQ ID NO: 2267 - DNA, 976 bp, Homo sapiens
  misc_feature (1)...(976): n = A,T,C or G
gnttgaaaacntatacaactacttgnnnnttttngcaggatcccanngnnnngggaganngnnnagccacngnccnnnggncccngnatttttnnncngcnnaaggccnctcccngnggntttanttcganngggnngganaacatttncacccaaaggcccaggangcntnntagncatttgggcccaaaacnnacacnttcngattntacagcgctnattannannaangatnaanatgancaaaagcannnngtcaaacnaattagtaccggcccgnccgcngtggntnacncccgnaaccccaacagttcgggangcccaggcggncgaatcacnaggtcntgagttccnnaanccgncncgaccnatatgggtgaaacccccccgccccnnctanaaaaaacangaanataancccgggnagngnctggccncccgccncgtagnacctangctaactcctggnaggctaanggtcagngagaaatccgctncgaatcccggngagggagngancgcccgcaagtgangtcccaagcacccgncccaactgncaacatctcnncccntgggggagnancannnacccncagcaatttcctcccccccccancaaaaaaaanannaaancggaaatcnntgcanaaacanantccncgaaggccnntaaacccnctcccccganacnccaatttnannacacacgcanccccccatatcccctanaancttntctcnttacccctcaacaagaaaaaaacnccnctctntnaancannccccnccacgggnancccaacaanntnttccnaaatttncgcggggcaaccngcaagnaatannganngaaccctacnnttggangnatnnnccntgggaccttcggggganctatcgctccncanancacacgncaccntaatanaaaaaannaaaactccgcctacaccatncggnggagaacaccactnng

SEQ ID NO: 2268 - DNA, 803 bp, Homo sapiens
  misc_feature (1)...(803): n = A,T,C or G
ngngnnnnnncnncnncnnnnctccctgnttaccaaagacactcacatctttaattttggtgtttcgatggaagcacaggatataattctctgcctccttaaattgttgaacgtgctgcaaagtttgacatttagaaatagaactagggctgtggggctttgttccgtctttagggctttgttctctgcccttgcgtacacactcgtgtgcatgtgtgagtgcatattacacaggtgcatgggataaccctactcttttaaggcagtatggaagtagcaaagctgctgtctttgtcttttcgggtgttgctggtctcctctgtcagcaccatcaaggctttgctgctcattgcactcatccagcagggtgctatcaggaagaaggagaatgagttccaaaaataaggtaacttattcaggcttcacatttgtctctatgttgggaatgatgctactctccctgcctgccttgtggaatggttataaanatanaatgagaggaagctcngaangtgtnatccaangtgttncacccntcatnaaacatnntcangnattgcaaacaaatggacttacgagtcaacctgactgaagggcagaaanttccaacncctattttaataagggttcgccctgnngttaatttggatcccacntttcntcattataaataanaaggtggggnttgaatnacaancattaaggggctggcgaataaacaatttaaaattcntggtcaacctttatgttaaaagaaatcttaattggaaaatnttattgnttgccaccattaacaagggncc

SEQ ID NO: 2269 - DNA, 935 bp, Homo sapiens
  misc_feature (1)...(935): n = A,T,C or G
agaaccttgaaancccnncnntgcngacccacgancnaatcgnccnanggtnaaagnaaaccaaccaggggtttttttganaaaccaanaaggaaagggaaggcgggnggagggcnaaacggccaanccgcttgtacnnaanancccgggggagggaaaaaaaccggnnaanccagtnnaaagnnccccgggggccgaaaaggnatgccgggaagaaacccnacccaacanaanaacccatnggaaangcccgccccnaaaangggacctggaaaccancaagcaancggncctggaaaaaaanggcccnggaccangnaaaatgggnaccaacngnccaaaaaaggggnccccggnaaaanntnaaaagcccanaaaggtaagganggnnaagggaggcnaagaaaaccaaacccacggggggggaaaaagnntncccaagccaaaccaagaanggaanggcctttnggagcccnccntggcccccanaccaanccctngnaagnggggaatgncagggcccccacanngggngggggaaanaaggccccanccgaagcccnnnncctcccaactgggcctggcccctccnctgggggggaaccaaaacaacccgaaaaagaaacnncanccacccccggncanggggncanaaggggggncacccngnacaaaaaccnnncnngggtcncaagnggggcanggantcccccaaagggaaaccccaggacccctataaancagnaaacaancccnaagtttngaantgnngggggacncaaaaaagggaaaaanaaaaaaaaaaaaaaaaaaaaacccccannccccnnaaaaaccaaaaggggnggcngcannaccgggggaaccccgacnngganaaggaaccnccnggangaagaatggggcnaancccccacccncnaaggccnggggan

SEQ ID NO: 2270 - DNA, 656 bp, Homo sapiens
  misc_feature (1)...(656): n = A,T,C or G
ccccnctngccttgnccgnttatcnaggatctttngcatnncatctgtcnctttngctgtnttgtaaatcngttaccgttatagtacctggtctgaaaggttgctggatgatcctaccaacagagaccattgaatgccgntcaaaatggactgaagcatcagcaatgtctgaaaaaaggcctgacngtaatgtacatgtcaaatggcccgtaatttaagccagagtagaagtaagtagaagaataaacatggggaaagttccagcaacanaggaggctttgagcttttgctcttcatcttgagtggatgttgttctcaggtggtaataggccatcgagctttctccactggctgcctctctggggaacaaataacccgaaaagatctcagcaccctggttggtacataggtggtcagttgatttatacttcctgggtttcagtgntgcttgaattttctaaatggaaacacagtacctttataatcagaaaacaatcccgagtttttgatttgaggggtgttgtaaaaagntaaaaaaaaaaaaaaaaaaaaaactccgccctttnaaacttttggggggtcgttttccgtnnatccccnccntgttaggaatcctttggtgagtttgggnccancccccccnccttaacnnnntt

SEQ ID NO: 2271 - DNA, 671 bp, Homo sapiens
  misc_feature (1)...(671): n = A,T,C or G
ntactcnaatagntnantaaaacctnaactngaatatntnaaatattgagcaagcctngctgttgtagagnagcancctggtctaacccgtccaaaaacaatgttagagacattaggaatcaggttttgaaaatctttttttccgatttatttgtnatttacataccaaaaaaccacattaaaatagtcctcccttcaacatggctatcttttttcaagttttatatgcatagctctctcagcacttgaatggaaaaactgttacagcatttgggagttgtttttcttttagacatttgcagatcttatctcaaggtgactaggaacccagagctaagtatctgtgaggcaatctctgcgaacgctgaacttacctagttggtttctatgaaatatgtagaatgcactgcagtagccattgnaagaaggtactataccggttttttggggcttggtgntgttgtttggtctgagaatgtactgccaacccctcttttataaganagaactgattttgatacatattttaaaatatgatagtacagagttaatggatgttaaaaatttatttctttgntttggtaagtagattaaatcgagaatcatataatcagtncatttgagaattatataccnggatataataatactggacnaancatttgncatct

SEQ ID NO: 2272 - DNA, 758 bp, Homo sapiens
  misc_feature (1)...(758): n = A,T,C or G
gttattcgttactcagcttgctgcctgcnggtcgantctnatngatncnanttccgcacgaggtgaaagcnnngcctcacgatccttctgaccttttgggttttaagcaggaggtgtcagaaaagttaccacaggggccagaacttccaccttgtggtcaattgtttcaagtgtgtgaccatacttgtcaagaaagtcaagtcttaccagataactgaaaaacagctccaagttctactggcctatgctgaggaggacatttatgatacttcaagacaagccactgcctttggtcttctgaaggcaattttatcaagaaagctgttggtcccagaaatcgatgaggtcatgcggaaagtatccaagttggcagtctctgcacaaagcgaacctgccagggtccagtgtagacaggtttttctgaaatatattcttgactatcccctgggtgacaaattgagaccaaacttggaattcatgctcgctcaactgaattacgaacatgagaccgggagagagtccaccttggaaatgatcgcctatctctttgacacgttccctcaggggctgctccatgagaactgcggaatgtctttatccctctttgctaatgacgatcaatgatgactctgccacgtgcaaaaagatggcatccatgacaatcaaagtccctacttggtaaaatcacctcgagaaaaaagaatggctgtttgatatnggtaccacttnggttgggagcaaaaaacccttaaatagat

SEQ ID NO: 2273 - DNA, 731 bp, Homo sapiens
  misc_feature (1)...(731): n = A,T,C or G
cttttgacccntttaacaaccacactctatggtgantggaattnnnaaatnaaaaagnnantaaatggatttggccaccntaaancaccanantttgaaatggttgantgagggccggaggccntgatnaaangggccctttgnaangggtnggggnggaagggaaannttnccgggngggngtnacctgtnggncttccaggncantttttggccntncanccntncctgcaggatgntcaaaagnnncggcccctnntgggaaggttaaaactggancaaacctttnccaaggggancattttcaccgtttacctggaagtctttttttcccacctggcttaatcaggttncaattttcaagggtaaacaactaccacttncaggatangggaagtggtgggtggaataaganaaccatgataccctggaggaaggggaagaaaccacaaancatttttccttactggaaaaaatangggtggacatgtcagtcaaaattcttgatcaacttggaaccttgagttttccagttaaattccattncactanggagggagttttctatcaaaatcctgccagatttgaagaanctggtttattagaaccacctgtcgcttttcaaagctgcttaaaaataagatctgcctcnccctagagatgatcatgggcctggtggggccaaaaatcccggngttttttaaccctntgcgattctnattgcagtaaaa

SEQ ID NO: 2274 - DNA, 867 bp, Homo sapiens
  misc_feature (1)...(867): n = A,T,C or G
tttacacgntcgctgcactgtgaacctgggcctccgcgccgatgccaccggcctgtgggtctctgaagggaccccccccaatcggactgccaaattctccggtttgccccgggatattatagaaaattatttgtatgaataatgaaaataaaacacacctcgtggcaaaaaaaaaaaaaaaaaaaaaaaaaaaaaaaaaaaaannccccnngnnccntaaaaaatttgggggggttttttnccnaaaancccncnctgttnnnnttttttggggggngnnncnnnccccccntnnnaannnnnnnnnnnnnnnnnnnnnnnnnnnnnnnnnnnnnnnnnnnnnnnnnnnnnnnnnnnnnnnnnnnnnnnatntnccannnnnnantttnnatnnnnnnntnnnnntnnnnnnncnnaatannttnnnnatnnannnnnntnnnnntnntntanttnnntnannnnnnncnnnnnnnnnntnnnnttnnnnannnnttnnnnnatcnatnnannnntnnnnnnnnnnnnntnnanannntnnnntnnnnntnnntnntnnnnnntnnnnnntntnnnnntanttnncnntnnatnnnnnnnnannnnacnnannnatnntnntnntnnnnnnnnanannnntattcnnnttcnnnnnntaanatnttnnnnatacnnnnnncanntannttnnntntntnnttnnnnttntnnaantaantnttnnnttagcannntctnttcnnnnncnttattntntnttntnnatnnatntnctttgtntnatntttntnatttnntannnancnntnnannncnnatnnantnttnnnnnnnannnnncattanctattcncngtncnanancc

SEQ ID NO: 2275 - DNA, 759 bp, Homo sapiens
  misc_feature (1)...(759): n = A,T,C or G
tnttatncgntcagctacttgttctttttgcaggatcccatcgattcgaattcggcacgagatttgaggatctcgaccttgtccttccagcaggtgctcccaagccacctctgggcctgagaataggcatcacatgactctgtttaatcctccgacacagcaaggatgccgggaagcagggcaaagtggttcaagttatccggcagcgaaactgggtggtcgtgggagggctgaacacacattaccgctacattggcaagaccatggattaccggggaaccatgatccctagtgaagcccccttgctccaccgccaggtcaaacttgtggatcctatggacaggaaacccactgagatcgagtggagatttactgaagcaggagagcgggtacgagtctccacacgatcagggagaattatccctaaacccgaatttcccagagctgatggcatcgtccctgaaacgtggattgatggccccaaagacacatcagtggaagatgctttagaaagaacctatgtgccctgtctaaagacactgcangaggaggtgatggaggccatggggatcaaggagacccggaaatacaagaaggtctattggtatttgacctggggcanaacaacttccttcccaacttctgtcccaccttgaagctgaggcacttnttttcagatgcccaataaagagcactttatgagtcaaaaaaaaaaaaaaaaaaaaaaaaaaactcgagccttttanaactatngtgggg

SEQ ID NO: 2276 - DNA, 758 bp, Homo sapiens
  misc_feature (1)...(758): n = A,T,C or G
gggccgggtctgccntcatagacatgaccaactgtccttctcctcgatcacagaccaggcagctggcatgaaagaggaccnnaagcaaaatgagccttttgtggccacccagtcatctgcctgcgtggatggccctgcaaaccattgagcgtaggatntgttgcattatgctagagcaccagggncagggtgcacggaagangctcaagtatgnttattncttatcacaatgcanaagccgaaaattatgtcnctttaagaaatacctacctgtttgcnatgtcntattaaaaaacnacaaanaaagacaaatggaacanagaaanctgtgaccccagcaggatgncnaatatgtgaggaaatganatgcccacctaaaatcatatgtgcaanattatctcgaccttccatangaggagaatacttgnancngtatgctgcctgtngttanaagcaaattttatacttttaactggaaactntggggttttgcatttaatcatttaactgacggctaaatagccancatttnttttttagaanctnaaaaaaangccctagnnctgtngntttntaaatnggnttatgcnnactcggnnctgncatgttcccccccccaaaatgaatttnntttttgtncgaaacctanggnnnacctcactnntttntaatcncctangtanncctncnctnttncctccntnttaaagnccnaaataattccttnttncnnngnnnncncnngctttacggcncca

SEQ ID NO: 2277 - DNA, 1212 bp, Homo sapiens
  misc_feature (1)...(1212): n = A,T,C or G
ngncntgatngaacgtnacngantgnngntacgtatatgttngatntgtgatnntgangtatntnnanagngtatgtgntgnttatgcgatnttattatanccnccnntatgntagtagtaacnannatanntagagtanttgngnnnatngggnnggngagngtatatttgagtcatatgtnnnatgaancagaaacatctncnanantntacgcatgnnnntngngnncngagccnntatgatanntgatgntnacgantcgtanttnngatntantccncgtntnggttnctgtcgannccnagtnannttanatgncccgnnngcnattaacnntantnnnggnntangtnngtgcgngnagtntancgnnaantacnagnanannatnnaggcnntattnnctaannnacgnnntngnntttattnantgtgtnannatggnaggaggagtacnnnnnatnattgcngtnngntngangtnntaganatgtntntncnccacnntattgcntangntgnanncgttnantagagtanacntncgcagaaggtacgcanctnatttantncangacaatgtngggcgtcncgntaatntngnntanganntccgagtnttgtanngancgtcataccnatngnngtnngcntntaanntgatgcngatgacncncgtncagtnnntaatatangannantcngtagggtcnctatntngttnatantgtnagacncacantatagagngantatactgaaatnntggntngagananatatatnagnntgtgttatntggcnnnatngncatatatatgatagnntgcgatnactacgnagtgtgggaacgctacacgcgtaggnttgcgtcnatatgnntnnctcgcgnangtgtnttttctcgctagnatngtgagtgaatgttncncanannaanggataatntntngtancccagcatntgacnangangatagataccgcacagtatntatncntgtatgtgtgtgtnctngngcntantgatcgcnagtatntngcntctnactactaannnatnactncgncgtacncagggananntncgaaagngcgcacnntatngaacgntanaacgtgcngantagatgtntcgacnnncncataggncntgatgtacaagtgatcanntgaannngtgganncnccatgntnnatnagnntnggt

SEQ ID NO: 2278 - DNA, 771 bp, Homo sapiens
  misc_feature (1)...(771): n = A,T,C or G
caccncgntcgantcggcacgagatgaaccatctgcttttaatgattttcagaggccagccatttattacatgatgtcattcagtgattggtatgagatgcaagatgctggaattacttcagactcaatgatgaagaacttcttctttgtgccttcttgcattcagctgagccaagaagacagcttttccgctgaagcttaaacaggcattaacgcttctttagatctgaagttgcaggttaagcttgtctggtcaacattccagtgtggaaaaataatttaaacaatcttattctcttaattcttttggcaacaaaaactattagtaatagctatttgggaccagacaaaatcagctttcatctataattcattggggataatgggagatttaagataatgtatccagatttaaacctaccagtttgcctaccccttangcgtttaaaataaaatatgcaacaaaatggatgacttaattggagatgggaagcccattaattgggttccccattaaatcggttacatacaaagaacacagtttttatactaaaggattttgnggttaaaggccttgtnaaaggttcatgtcttttcacccagaatttttcaaaatggttagaagaacnagnnggggactttctttaanaataaccggtttangtggnattttaagaaaagngggtnaaatttgnggccttttgaacctgggagttttnaataaaatgnnnaaaaatnccattcataancaatttnggtngancctaanng

SEQ ID NO: 2279 - DNA, 733 bp, Homo sapiens
  misc_feature (1)...(733): n = A,T,C or G
accncgntcganttcggcacgaggggtggcctgtccagctcagcatccttggaagtggccacgtacaccttcctccagcagctctgtccagactcgggcacaatagctgcccgcgcccaggtgtgtcagcaggccgagcacagcttcgcagggatgccctgtggcatcatggaccagttcatctcacttatgggacagaaaggccacgcgctgctcattgactgcaggtccttggagaccagcctggtgccactctcggaccccaagctggccgtgctcatcaccaactctaatgtccgccactccctggcctccagcgagtaccctgtgcggcggcgccaatgtgaagaagtggcccgggcgctgggcaaggaaagcctccgggaggtacaactggaagagctagagctgncagggacctggtgagcaaagagggcttccggcgggcccggcacgttggtgggggagaatncggcgcacggcccaagcaagcggccgnccttgagacgtggcgacnacagagcctttggccgcctcattggtggagaaccaccgntcanctcananacgactatgaagngaactngccaaaacttgaccaacttgtggaaggttgcccttgcttgtgccnngggtttatggnaagccccnttaacnggcngtggnttcngtgnntnancggnananttnttggangcctccctttttccaacccntnggganaatcaagaat

SEQ ID NO: 2280 - DNA, 734 bp, Homo sapiens
  misc_feature (1)...(734): n = A,T,C or G
ccntcgnatcgancggcacgagaaagtgaatatcgagttggtaacgccaagaataccagaaattctggaaatccatgaagcagcagcataagtggtttgcctctttctccagcagcaacatagtgaaatcttaaccctgaatccttgtattcttggcgttaccaactgagagaatttaaaagtgaatatcgagttgtagcactggatttgagaggttatggagaaacagatgctcccattcatcgacagaattataaattggattgtctaattacagatataaaggatattttagattctttagggtatagcaaatgtgttcttattggccatgactgggggggcatgattgcttggctaattgccatctgttatcctgaaatggtgatgaagcttattgttattaacttccctcatccaaatgtatttacagaatatattttacgacaccctgctcagctgttgaaatccagttattattacttcttccaaataccatggttcccagaatttatgttctcaataaatggatttcaagggtttgaaacatctgtttaccagtcacagcactggcattggaagaaaaggatgcccattaacnacagaaggatcttgaagcttatatttatgnctttttctcacctggagcattaagtggcccaattnaccattacccgaaatatcttcagcttggctggcctntcaaacattaaaatngnggcccacttccncnt

SEQ ID NO: 2281 - DNA, 766 bp, Homo sapiens
  misc_feature (1)...(766): n = A,T,C or G
accncgatcgaatcggcacgaggtggaagaagaaaagnttcctacacanctgagcaggcatattaagtttggtcngaaatncatgtggagtgtgctcgattttctccagatggtcagtatttggtcactgggtctgttgatggattcattgaagtatggaactttactactggaaaaatcagaaaggatcttaagtaccaggcccaagataactttatgatgatggatgatgctgtcctctgcatgtgtttcagcagagatacagaaatgttagcaactggggcccaagatggaaaaatcaaggtgtggaagattcagagtggacaatgtttaaggagatttgagagggcacacagtaagggtgtcacctgtctaagcttttctaaggatagcagtcagatccttagtgcttcttttgaccagacaattagaattcatggtttaaaatctgggaaaaccctgaaggaatttcnnggcccttcctcctttgttaacgaagccacatttacacaagatggacattaccttattaagtgcatcctctgatggcactgtaaagatcttggaatatgaaaacccccagaatggtncaaaatacctttnaaatccctgggccagcncccgcaagggacaagatatttacccgnccaancaggnggggaatctaactttccttaaaaacccttggaccacttttgtgggtggtgcaaccaanaancaaaaaccccggnggggtcattncatgaaccatgccangggggccana

SEQ ID NO: 2282 - DNA, 1226 bp, Homo sapiens
  misc_feature (1)...(1226): n = A,T,C or G
aagaacggnntttnaangnntntttntnttnangganantgtagtntaaattcatttnttaattngaacgacnccgntncnacngtatcttgaattangggtnggtggaaggcncccatgtcnacanatntnacatatatnttatattnncanntngacanatntaattntttncangctgaacnatcggggggggggngagnngatcctatctcgttantggtatganttnantcgcgncnatcnntctccgnatatttaatntttatanttngatcgttgganngangnatntacnatatnatatngantntgtaccattnntnacgatcnaatgtncttannnctnaantttcncncgncnggncatanggntcnntnannnncntgtnnantccgcaatgatagntatatgntnnnnaanntgnngncannntnngnaccatncttncnnggtttgngcgcntanttanncanancncatnggantntatnanancccnctgggnnntntaaaagntatangccnanntntncnngctnantnggttgnncnatnnnnnnanttnnaantaacngggnatanntcgctgcactcgatttannccnccgnnnantnantgnnccncntnnntnnngcaangatnacanatgagtnnnagnnnnngtnnntatttgnacaatntncgtncgacgcngnngatcntntattntgacatatgaggnngcaanttatgcgcagntnttccancnatangatattcgnatnaacatngtggtgtatgcnanatcncccnangananntcgttnntatntanntnngctacacggncanttntnacatacccatcnnnannatnnnnccncnnnacgntngcnagtntcgaacacatctgcgnggttaancgtngagacnctnncgnnatagantaattaggantgctcaatcatcngcactntatgngcgtacgaacgtatntgtatatntgagtnatatgtgcgatatgcgattgttntnatatnccnacntgatcatntgtatgagtatcnanngtngncccgatatgangnggngttngnnaganatatcgaaatataangtgtntgccgtgacngaggtcgtcgaantncgagctcgcgtgntnggacangtgtatagntnngcgtaaagganttgacggngntcgcatgatgtannctacgatntntgagtgcnanacagagt

SEQ ID NO: 2283 - DNA, 1327 bp, Homo sapiens
  misc_feature (1)...(1327): n = A,T,C or G
ttggggggggggggcnaanacccggccnnttntaangtttncnagaaaaaaagngaaatgggntagactcccttttccggagtnnaatncacngannagtnnggcngaacgggntttgtntnaaantttatnanacncgccncacnccnatcagtnaatatcggccnnccccccattntatgtaaagcagtnntatattngtggatntnaccccccccccngccncntagntgtgttatgcgcatgcacgataagtgngnggggggnggnggtctanntatctatttncacacncggggnatgataaancgncgtaagnggttctcactcantntgagtngggtatataatatatannattatccanncgtncatnanaatggatacgcnnncgtattgattttgnatncaccncgtnncatatnctncggcgcaccactaggtcgtgnganctaacnnacctcacatcgcttctggtgngnctnnntnanganncgnncgaanacttcggatataantnannatgacagntatncttnattngtgcccannaananntanncngncanntatctctngtaaatantggtannagactcgnnttgatatntancntcngtnatgttcngatctnnccattcnaacnaggctacttannaaacccnnnnngtgannntgngtngcntntnnaannangntcncntatgtnnngnnnntcccannnnacnancnnatnntccnnattatgtgngangggtcgnaaangttntnnannnantctannagctnnncantganncgngcatngtacnnnangaacntatcgnctncnntnntgtgaanttnncgcgntgacnantncnntggtnnagcgngcnaccncttngaactngtctnctcctaatnccctgnnngatnggntatatnnnttgttntcgncntggganngtntattgntgtgcntatctatanatgtgcccctcgctgagacnacgaggttgtatnctgnnaannagntnnattgtggngtnnaatangcctnagcnnaaaaatgtgnnnaacacacnatttntgtaacacnactcgtntnttgtntntnaccncaanagangccgnggggagtntntaaantnncatgtnggggtctatactcacacngnggnanacngttantcangatgacgaganatncactnggcacgtgngngaaggncacagnttactatgttgnnaagananagnaagcgatatctctcctcgncgatgtctnataccnnngcnnccgtanatataagngantgtaggacntnactaacgnnccacncnt

SEQ ID NO: 2284 - DNA, 734 bp, Homo sapiens
  misc_feature (1)...(734): n = A,T,C or G
accnngntcgaatcggcacgacctccatgaaggatatttttggagtcgtaggagttacatctgctaacatgcttattttcattcttccttcatctctttatttaaaaatcacagaccaggatggagataaaggaactcaaagaatttgggctgcccttttcttgggcctgggggtgntgttctccttggtcagcattcccttggtcatctatgactgggcctgctcatcgagtagtgacgaaggccactgaaacccgccgagaaaaagaaacatccctgttgtctgctcagtcaagtccccacacatcagcaatctctcaccacttcttttgcaagtttacagaagcaaacagaaatgtacaggatacttaaaatggaataactttttggttgcaaaacagagacatggttctataatgcttcatgtccctccaagatttgagatcaatttagggattgtgaattntttttttcaaatttcatacaatcatatttcccagtactttncacaatcattttttacccatctaactctatgttttgnggcttcccggtctcttagaactttgaaaacatgatataccaataatgntnatttattatccatccggattctgaaataattttcctactggatggttnagctcacacttatctgnaccttttttaagaaganaaaaagantcttgaattggatatatttatttcgctttacagaaaaaaatgggttccca

SEQ ID NO: 2285 - DNA, 719 bp, Homo sapiens
  misc_feature (1)...(719): n = A,T,C or G
acctcgntcgattcgcacgagcccagagcaccacagccgcaggcgccccagcaaccacagcagcagcagcagcagcagccaccaccatcacaacagcctccaccaacacagcagcagccacagcagtttagaaatgataacaggcagcagttcaattcaggtagagaccaagaaaggtttggaagaagatcttttggaaatagggtggaaaatgaccgggaacggtatgggaaccgtaatgatgatagagataatagtaaccgngacaggagagagtggggaaggaggagccctgaccgggacaggcacagagacttggaagagagaaatagacgctctagtgggcatcgagacagagagagagattctagagatagagagtctcgtagagagaaggaagaagcccgaggaaaggaaaagcctgaggtgacagacagggcaggtggtaacaaaaccgttgaaccttccattagccaagtgggaaatgtagacactgcttcagaacttgagaagggggtgtctgaggcttgcagtcctaaagccttctgaagagttacctgctgagctcctcatccgttgaacccgaaaaggattctggcttaacagcagaagctccttcgttaganactggaatttgtgaaaatgtnacagtgacctttctggaatgtaancttgangtgtcaaatgctgtattttatccnntccnttgtctgnagccc

SEQ ID NO: 2286 - DNA, 764 bp, Homo sapiens
  misc_feature (1)...(764): n = A,T,C or G
nntcnttctgtntcntcaaggtnttnttntcnngnatattgcagtcngcacaattgagaganccaatggnctgnncaatcgccncatagagganannnacatggnnctgnnaggaatggtggttgtggatganttacatatgntgggagactctcaccgagggtatctgctggaacttntgctgaccaagatncgctntattactcngaaatcagcatctcgtcaggcagatctanccagttctctgtcnaatgctgngcaaatcncngggatgagtgctncccttcctaatntggagctcgtggcttcctggctgaatgctgaactctaccataccgactttngccctgnaccgcttttggagtcagnaaaagttggaaatcccatanatgactctttcaatgaaacttgtgagggaatttganccccatgctacaagtgaagggagacgaggaccatgttgcncagtnatgttatgagacnatntgtgataacnatttcnctattantttttttgccnatcaaagaaacggtgtgngaaagcctggcatatntcattgcnngagaantttaatnaccttacattnatcaaacngnnggggantggnngaaaccccttntgaatgcccaccccgtnatttnttggaaaaaaaaaagannttntttggaanctnnnnggggaacaaatatannaaaccnttcnnccttttangaacngggnacncntgtcttaaaanaaaanttgncaccnatgggggnncnnn

SEQ ID NO: 2287 - DNA, 995 bp, Homo sapiens
  misc_feature (1)...(995): n = A,T,C or G
cnncannnnnnncnactgcnnnnnnnnnnnatancgaannncntanannnnnantnntctnncntnnnntcacnnaannnnnnnncntnncnnancttnnnntnnnnntnnntangnnanttnnnttantttaatgcntntnnnntnannntcgcgcccnncntcncatnnntcccntcnctccccnnanntnncaagngtnctttngnaaantcangnnngattntancttcngtncccnccccccctctannnttcgnacctgcaggcatgcaancnttgagtttttntataggggtacctaaatagcttggngggggcattttcatagctggantcctgngtgaaaattgttatccgctcacaattccacacaacatacgagccggaagcataaaggtgtaaagccttggggtgcctaatgagtgagcctaactcacattaattgcgttgcgctcactgcccgctttccaagcgggaaacctgtcgtgccagctgcattaatgaatcggccaaccgcgcggngagaggcngtttgcgtattgggcgctcttccgcttcctcgctcacttgactcgcttgcgctcggtcgttcggctgcggcgagcggtatcaagctcactcaaaggcggnaaataacngttattccacagaatcacgggggataaccgcaaggaaagaacattgtggagcaaaaaggccaaccnnaaggccagggaaccntaaaaaagggncgcgttgcttggcggttttccattaggctcccgcccccctggacngagcatnaacaaaaantncgacgcttcaantcaaganggtggncgaaaacccgacaggantaataaaagataacccanggcggtttcncccctggaaagcctccctccatgccncctntccttgntccnaacccttgccgcttaacccggaancttgccngcntttttnccttnngggaaancgtgggcgccctttctcantagctcaccctntan

SEQ ID NO: 2288 - DNA, 758 bp, Homo sapiens
  misc_feature (1)...(758): n = A,T,C or G
natattcgatcaagctacttgttctttttgcaggatcccatcgattcgaattcggcacgagtggagaggccttggcaaaatggctcatcacgttcaggccctccgggctgagttgtcagcagtatcaagggaggggcctgctctatccccagaaggatcaggatcatatccaggatgccccacatacaccaagccaggcagagggcagctcagctcctgtcccatctgctttggatatctttacccaaaggcaggtaacccgaagagccagcctccactgcccacagagccaggcccagttgtgttggagtataggtcaggagctgtggaaggaggcagtctgtgagggactcatgctttaggagtcctcacccctcagactgctgcaggacattgccaggcctctctccacttccttcctcagcatacagacttcatgctatcttccaattccggggagtcttagctattagggcagtttctgcttctccattttggggacaaaggccttgcccagtacaaatctagccccttgtcccacagacttctggatggtataaacctagtggcaatgtancaaccataggctagaaccaaacccaagatttgggtcagtgccctgttaaagggttttaggattggtaaggacaccacagctaaatctgacatgtaaaaggatacccttcccttgtccactacgggtggaggctaaggacctcctcaaatcccacaaaatggctggtgacattggcacaagg

SEQ ID NO: 2289 - DNA, 728 bp, Homo sapiens
  misc_feature (1)...(728): n = A,T,C or G
tttantcnttngcacatgtctacccagaaattttgttcntgacctgacgcccaccttctatggtgccatcaagaaacctcggcaccaaccaatgcctggatgtgggtgagaacaaccgcggggggaagcccctcatcatgtactcctgccacggccttggcggcaaccagtactttgagtacacaactcagagggaccttcgccacaacatcgcaaagcagctgtgtctacatgtcagcaagggtgctctgggccttgggagctgtcacttcactggcaagaatagccaggtccccaaggacgaggaatgggaattggcccaggatcagctcatcaggaactcaggatctggtacctgcctgacatcccaggacaaaaagccagccatggccccctgcaatcccagtgacccccatcagttgtggctctttgtctaggacccagatcatccccagagagagcccccacaagctcctcaggaaacaggattgctgatgtctgggaacctgatcaccagcttctctggaggccgtaaagatggatttctaaacccactgggtggcaaggcaggacttcctaatccttgcaacaacattgggcccattttctttccttcacaccgatggaaganaccattaggacatatatttagcctagcgttttncttgttctagaaatagaagcttccaaagtagggaangcacttggggganggttcaaggcacaat

SEQ ID NO: 2290 - DNA, 1460 bp, Homo sapiens
  misc_feature (1)...(1460): n = A,T,C or G
agcggnncgnnnnncggggaagnnnnannnagnnaangngnnnnangngnanannnanangnggnaaannnnnngagcncncnnngngnnnnacaagngnnaaggnncagaangggancangcaacgnagnncgagngngcngnanaagnaannaagnnnggganngnagaanagagagcagagnagannnaacggcggcnncncncnnangttnnnngaaaccccgtttgnnnaaaaccacccagnncaggaanaagaagtagagcnacnaaanagcnagncngcngagncnggnannaanangaannngggggggngggggggggggggaanggcnaacnctttnnngnnacnagggcaagggnaanccgnagngcannggnngggggnnggnnacacnaagcnagnaaacnannnnataaangnggangagnagngngnnancgggggnannaagggnnannnggnaanngnncgagaanagaagggngganngncgnnncanaagggnggcaganagggaaggcnggaaaaagggaagganaccnatgggggangagaagggagagnnnnnnnaggngcanaggagcagaancgcaanncganaagnggnnngggncngancganaaantngnngggaganannngngganccnnggggngaganngnaaacncangggancnanaggcaangngtgcgngncgcnnggaagnnncggaagagncgcgatcggngngaacgcngagcgcagancagntcggnaagngagnncgnaggcaacgggaagaagagcggaggagnacnngaatcgcngagaacgcggaggagcgcgcaggangngcgggannngagaacagaacgnatggaagggannggagaggganangngagantcaaagcatgangacagaaacacacgagagangnncggagaaaangacgaggagngngganananagngaangagacnnnnaggaanagangggnangaaagggaatggagaaagnganngaggananangacgcgngcgagagcggataacgcngaacgcnanngaantngagnaacacacgcgngcncacgcncgcacngaccacnganngagacgnagcatngngagaggcggnnaacngcngacgagacacantcaaganngncgnanccnacggcgancgnggngaacangnntngacganangcacgaacgggagcgaaagntncngaaangnnanngantagaagcagaancgnaacngnaagggnccaggcgnaaaggntnggcccngcaagagnngagcnnagagganangnggaaagangcgcgggnntganncncaaccgaccgnggcgannaganntnncgcnagggnaggnnanggatgaggnanaacnnnaggggagnnngnatagngaagccagagaagcaggcngcnagangnagnnngangggacn

SEQ ID NO: 2291 - DNA, 1412 bp, Homo sapiens
  misc_feature (1)...(1412): n = A,T,C or G
acnnccggntcgnaggncaatggngncngtanaannnannggnnnnnaaanaaanngtgaangcntantacnngcgnnannngngttanctacgtangangaaanggtnnncncngctgcgagnagctaannnnncgggancnanagnannannnggatncganatagggacgaaggananngaatcgcnnagacngangnngaaantgcgnngtncnnncnncccacncnggttntgaaaacccccgttatacggccccttcttcttcccganggacacagngcagccncntnaccccccgtcgncactggagaaaatngtcagaggagccncgggnnggggnggggngnggggcgnctnatgtnttaaanttttggngangaacgcagtnntggaggnnacnagcatgcgnnangnccatanantgcnangggancnggcagggatggcatctgntnacccccaaccgancgacgccnnnaannccgggngnaccacngngnccacgnccccggangcannanaagccangnaggccgncnaggnnnannannntngggcacnananncaggangacngnaggagncgngccngcanaannangngtacnngnnacganaannanngccggaagagnnncgcngatacnnccgnagancnganaaangngnannanaatagcnnnanangannagacgnnggnccntcnatgnagaangagaaancanacntggacganncntngnagngatgggnttgcatnnccacngggtnccacnncnnantcatngnnangnncgaaagnngngangaaanagcagggnntntgnaggncaaatgcggacnncnnnnggggtangcgagaatcggaanatcnnctngangggnnnnacgcctcnagtcntcgcgcncannnnagnangggngganagacntatntagangncgaccantnnangacacngangngcntntgantnnnagagacatagatcagtnganangtancnnnaatgcntctcanagagnnncaanaaacggattnggactntatcatgtgnngcagnggnnaanaaanaaactcntncgcgagnatgtnntgcgnttnaanncgncgatactnangtaagaaananacnccccgtanangngantnatcnacgcnngggnnngcaagaaaaanacctngaaanaagangggaaagnnangaatnnggacccgatgcaagnganacngtctaacgnacaaggtgacacaacncacgagncgatcgaagtcacngtcaccggcaaaacggnggnnnttctcaaaangggngngatantacgtgctcacgcganngggacanatananngactgantgtnaagagcanaacgaccatgcttcanacgngggnganacccgcgc

SEQ ID NO: 2292 - DNA, 775 bp, Homo sapiens
  misc_feature (1)...(775): n = A,T,C or G
tgttattcgttcaactcttgttctntttgcgcgngctcncanngatccccnattcggcacnnggtgncttctgtggaaaaaanattanttctttaccattgcancgttctgccctnggtccaaatgttaccaanntcactctanaatcttttnttgcctggaagaaaaggaananacaagaaaagattgataaacttgaacaagatatggnaaganggaaagctgacttcaaagcagggaaagcactagtgatcagtggtcntgaagtgtttnaatttcntcctganctggtcaatgatnatgatgaggaancagatgattcccgctacacccagggaacaggtggtgatgangtttangattcatttgagtgtaaatgacatagatttanccctgtacatcccaagagatgtatatnaancaggtattactgtanccagtcttgaaagattcaacncatatacttnagataangatgaanacnaattaagtgaancttctggaggtanggctgannatggnnaatnaagtgacttggacngaggacancnnanagggagngaacggaanatggngccactagatgctgttcctgtttgatgaanatcttttcactnnaataaggatttggattganctttagaacaattnnattacacttggttttgannaaatgacaccnttcacttcgcttgtanaanattatgtcaactcatcccgagttgaaattgnctacattantttctttccaccttgnatcaactgatgntttttc

SEQ ID NO: 2293 - DNA, 1186 bp, Homo sapiens
  misc_feature (1)...(1186): n = A,T,C or G
cgncgnganngnangggnggngggcngcnggnngnngangnngngnngangannnngcnanngcnngcgnncnagcgcnnngangcgnngcncgcgngcnnncngncgcgcnncnnngncgncgggnngcgggggnnangnngagnncnngngcggncnnnngcgggnngnnncngcngnnngannnncangcnncacccccnnancnngagngannccttcgnaacnacccggccgnggancgnnnagnnnnccccncccccngncncngcggncnngngcgggggggggggancacctttttgcngcccagnnggccacggncgcnccggggggcnnnnngaacgancgcngnngnncnangggccgacnngnaaaccnncccgggggancnnggnncggcngngacgnanccnccncacngaggaccggcggtgcgccggggcaaganggnccggnagccgcancangnggncgagnangggccggccgcgngggcacnagncnagnggcccgncacggncnccganccgaagcagggggaggancnnacgncgggganaaggggcccgccagcacgngganggcaggtgnggcctcatngganccnnnnacccnggangagggnanggnnggcncncaaggggggngnnnangangagcccgnnccgnngccaagctgcagcccgcgcggggnnnggcncnncncncggggggggangaccnaacagcgcnccncgcggagacnnnggangncnacaggncncccccgcgggnnntggggcgancaacgcncggngnggggccncagngaccgcgaggangcagacacccncnccnncgggggnnnngccngccgggnncggcgccgggagancggcgncncangnagngggaaacgccgccnggnaccccgncgcanaggcgcggcgcgnnanagacccggnganccccngggngaanggcgganacacngggngggggngggtctngcgcnnaancnggggcgctgncancncnngccacgcacncggcgcngnnggccngcggcgcccccgcngancngagcangggnggnagccgcccnnaccngnnncgcggccacgccagcggncgcacgnagngncctcgggggcgcgnnaggcgncnangcnncccgnccgcgngggggncgcggcncgngccg

SEQ ID NO: 2294 - DNA, 1338 bp, Homo sapiens
  misc_feature (1)...(1338): n = A,T,C or G
anaaccnncngngccggngacgnnnnnnangaaaaacnngnnanngannngggaangaggaaaaaangaacaannnaanangaacannngananggaaangnngngangangaaangcgcaggaaanangnncaaananggnnngngannnnnacgagngagggnacgcagagaannnnaacgnanacgcgnnggngancgaangaanatcgnagaganaggnacagaaagnagcnnacnacncnnncccnccnnggntgggaaaacccncgtttgggnaaaaaccccccnngngnagnanggaaanaacanngcngagagnangnaancggaaagngnaaacaaangnagnnggggggggngnaagnntttntttnnaatannagagannggacnggganaaaaggnggagnaanggaaaancannnaaacncanaagcgnntntatcanagcgcacgnnngagaannacgaacangnnnacgnnaannngnaantaggaaganngnnnaaanngaaganananggaagnagccgnnaaancgaangngaanannacgggagacacgannaaannanncncacnannnatagnaaatgaagaggnnagggnggngnnntganaacnggacggaaggnncnngngaancnnaagccacaagntnngcnaaangcggnnaacnagacgaacgagacgcngacancgnaacancnncgnaacacaaaagccaanaggganacnagaagnggncgnntnnnannnnngcaaagggacacagnctggnaanganngaaagnggngctngccnanacggancaaggnaacgggaaaagggggccgnngaaaaaancnancncacanggggaaaccaaaacgnnnaacngntnnagaaatacgnaggggacnaaaggggggaaagcnaacaagnagcgagcnnggggagnannaanggggggnagacncngncgnaaggagggtnngnggnncnangancccnagcacnngcgngcnggaaancnncacnaaggggcgagaanagaggnanaaggnganncgaacagaanannaacaacnacagggagggcnagaaagcgagggnacnangnactnaaggcggaacncgaangganaaggnnnncacangcacgggaaagnnncaccncnnncnanngngngaaaaanggcnaantcgctaaagagaanagnaanangaaccaangggangaanngagggaaaaanncncngcnnagnagantcgncgnangagaaaaaagagaaaacagaanggganagcggnggcnancncngaanggggagagaggcgcaaggcnnatccg

SEQ ID NO: 2295 - DNA, 1013 bp, Homo sapiens
  misc_feature (1)...(1013): n = A,T,C or G
gannactgaaaaattntncccttaattaaccttccaagggccctattgncnnggnggnncttgttttttttggncccangggccaattcccccccaattnccggnaatttnccccggtggggaaccaattttttgggggtttttttgggttgggtncctgggcctttaaaaaaaaatccnaccnttaaaaatttaaaagggccctttngggtngggggtntnggccnncccaaccaattgggaaccgaaaaaaaaagggggggnaaaaatggcccantttttggccaatggnaacancaagccattttccaataaggggttccccngggccaccnttttttggttttctgggaaccaagttattttttaaccaagcttttaattggaatggaaatatattggtactttgggaattggccctgggttttctctttctttgatttngatccgctactgtgtcagtgtttgcaatcagattgcgtctcacctgcacatacatgtctttcagaatcaaggtctctacagctcattctaatcatcattaatgatgtaattggtatataggaacatcatgttttctgcaggaaagaaagtaacatattaagggagaatgggggtggataaagaacaaatataatttataataatcaatgntggtataacttttattctttattattggtaacacgccctaactatcctgtgtgagaatgggaaatttcaagtcccatcttgtaaattgtatatgttggtcatgcagggtttgggccaagaaagcattgcacaaaaaaaatgccatgtgattgtaaattatcctgggattcannaataaatactgnggatgggggagcccccatccgcagtgggtgggaagaagttcctaatggttggactggtttgccaggcccaaaaagaatgaatngcttttaataantttaaacaaaatcattgggcctttttantaaaccatccccttggttttaggggggccttcttcaagccctntcctttnn

SEQ ID NO: 2296 - DNA, 1694 bp, Homo sapiens
  misc_feature (1)...(1694): n = A,T,C or G
cgacnttncngtgtntatgagnnnnntancgngataaagnncgtgtngntnnntatatntnntntnantnantntnacgannctgtggatncngntgtgcatgtgaggtgatngnctnattcgctntctngtnntcgnncgnntgtatgntnatgantatgtnncngagatgtgtgnatgaatgntantanacnnnnnanattgtngaaanaccccncttcgnaaaagaacccccnggtnngttatatgtgtantactnncgctntnatnngtnnccgacgccagagtgttnagattngatgagnnntanatgngtgggngggggngggngntgantgtatatgtntnataatntaggtangntangtntngagngtatgtggtnngtagacagncggnngtgantgtnnngtnnctttanaagtatggtcgtctatcgcgnnattgattntttattncatagngttnntantgtnggangtttnatgntacanantngtngagnanggtcgattanttnnnngggcgnggngagatgnnngnnnatgacagntngngcngtcntgagannnagnggtgtngngnncnttcnnangtgtagntttancttntcgtnntgacnnngggnntnnaatggncngggngtnaggatgtnanntnggntatnagtatgagnnnnggnnnnantcgannnncataaatgtangnnntgtgctgatgtgnnncnanggngantggggaantnngtggnnnttatagnnatnatcgancgtgttcnaatgnttgntgncgnnnnncnngnnatgtnatgcnngngtgcnntnnnntcngtgtgnnttaaanctntgttgggttgggtgtgtggtatgatngcaggncatngtatctngtnncnanatggangagcggatgntggtnanatatnngatangnngatngagngntcgnatgagnnatgngncgcgngtatgagntcgnatggtgnntntatanangggtntncacgcgtggtngcncgtgtgntnnnctttntagcgcntnggntgcgtactanntgnnaggggnnnaananntnntnnnaacntaanngnncncgtgcnangntcgcggncatctggtnncgntngaagaatagtcntagtgacgagcnggacgttcnctgcnntatnaccnnacncgtgnngatactannagatgaggtnncgactgganatnnttnnatnatcatnnaatnttnangangggaagganncgtccntnggnnggagattntntgngnanngcgnagtgnnntcgngancgtgatngnatangggnantaggcgnntagnanttgtgatgatgaaggggtctataagcgtggtnagnttggtgntgaggtatgagacnnanatgtntagatatnctatatgaggatganntangggtcgatgtcgatgtctngggtntntntnggataatngcatacgtcgntntntnnngancntntnacagtttanancgaaatatatnntanncgtgcgacncaaatatgaattgatacaatacggtgtangnggttttatgtatntgangntganangtgtgtnancnttatgatgacnggtatnatcgtatntgccggtancntcgnatntgtanatgtgaacgatntcgcanngnnactantntgcntatgtntnnnantgatccgt

SEQ ID NO: 2297 - DNA, 768 bp, Homo sapiens
  misc_feature (1)...(768): n = A,T,C or G
taatncgatactcacgcttgcatgcctgcaggtcgactctagaggatccnnattccgcacnagacanaacctcntnattaaagacaaatttatcagaaanatgggtgcacaaagagggctttantggcttnaagaggtatgtgaccgntgccgatgacanngagctngaagccaanatcgcagttgttgaaaagtataacatcagngattccagagctggtgcaaagggatagaaaaatgccatatatgaagatttggactttgcntagtacattctgggcactgngcacaaagccaaaggcctgnantttgacactgtgcatgttttggatgatttagngaaagtgccttgtgcccggnntaacctgtnccagcttncgcacttcaganttgantcattttctgaggatgaatggantttactgtatgttgcagtaactcgagccaagaagcntctcatcatgaccaaatcattggaaaacattttgactntggctggggagtacttcttgcaagcagagctgacaagcacgtcttaaaaacaggcgtggtgcgctgctgcgtgggacagtgcaacaatgccatccctgttgacaccgtccttaccttgaanaactgcccatcacctatagcaacaggaaaggaaaacaagggggggctaccnnttgncctccttgnccggagcaacgcatcnggccccttggcgtttcttgaaagncttcccggacangtgcgcccccatggaaccgcactggngganaaaaatcc

SEQ ID NO: 2298 - DNA, 1407 bp, Homo sapiens
  misc_feature (1)...(1407): n = A,T,C or G
nccacaancaatanaggaaggngttgtnganngggantanaaagnaanaantngnnntncacngacanangntnngnancnaagatnnaancgaagacgattgantacnngtcaanaaagggtnantantcgagacaagacaagcacatangagggcgngaaacgatnttngactnggnnannangtanatnctnacngacatgtntncacngngcaggnnnanatnngagatacgancantcacnanannanactgnggaaaaccccccttctgcananatccataccgtanantnacngncncgntnaatactgcgtnnnacaacancgcacnccncannanannncagnngnnntnacgcgncgnannntaggnnggnggagggggtgggagananatntctacnacatacgnannacgctnntanacnaactgatgaannnaccnggaccngtngnngtctanaaaanacgaganctccngagcanntncataatcannanatgctnaacgcnnncatnaganngnntnnctcanngatnnaggtnngtncggntatnntnngntggatnntnnngngnangngangngtntgnctganntcnacnnntngnangtgatncgtnnngnannaacnancnaaantggcaggnnncgantntaattancgnnaactgtagatagnccnncnnnanaggaatncgcnnnttgggaaancnnantanccngaaganggannncgnngcgnggancncgcnncnagaccnngtgatnnggaancntgtcaagatntntactggngcagcnatnagngggacnaanncaggtnnngnccncgngnnngcacatatcaangncnaggcnnngggncatgnntcnccgncacancagatncaccaanattcnaannagtnagncnaaacntannggcggaganngngnntaacangagngtgggnnncacngnnaaaaatanngancaacanagttannccnnacactgncncgcgagngangnganngcgncacanaacnnnnngaangcancatnnnnggncngagannacgaanngngnatngngcncnaaaantaattngngggggacaaaangatagggtnnnnnaaaannggngggggaatggggatcctgaanacnaaatccanantggnaggnnagcntggcgttaccnggngcgcnaatnggaancacncggntnnttnatagggnataaangnncannganggngcgggnaggaanatananncacgcaanaactcnnggtgttaaagagaaatnctnnnaaagaagnntanccgagcggtcactatgaangccgngnagangggctgtnnntnccnanttgnannncncacatntcnncangnaggaacnngactggnng

SEQ ID NO: 2299 - DNA, 717 bp, Homo sapiens
  misc_feature (1)...(717): n = A,T,C or G
ntnantcnntcgattccgcngagaacncacntttnncagcccncctgnaggccnagganacatnaaatatggcntatatnctgtagagaatgagcntatgaatcggctacagtctcaaagggcaatgcttctgcagggcactgaaagcctgaccgggccacccaaagtattgaacgttctcatcggattgccacagagactgaccagattggctcagaaatcatagaagagctgggggaacaacgagaccagttagaacgtaccaagagtagactggtaaacacaagtgaaaacttgagcaaaagtcggaagattctccgttcaatgtccagaaaagtgacaaccaacaagctgctgctttccattatcatcttactggagctcgccatcctgggaggcctggtttactacaaattctttcgcagccattgaacttctatagggaagggtttgtggaccagaactttgaccttgtgaatgcatgatgttagggatgtggatagaataagcatattgctgctgtgggctgacagttcaaggatgcactgtataccaggctgtgggaggagggaggaaagatgaaaaaccacttaaatgtgaaggaacaacagcacaagaccagtatgatataccaaggtaataaatgctgtttatgacttcttttannaaaaaaannnnnnnnnnnnnnnnnnnnnnnnnnaaaaaccnnttctttnt

SEQ ID NO: 2300 - DNA, 765 bp, Homo sapiens
  misc_feature (1)...(765): n = A,T,C or G
tattatncgntcagctnctggtcctttttgcgagatccctcgattcgaattcggcacgagcaggaataatgctgacatacatacatatntatatatatatgaagagagagagagagtcncacacagacagacagacacacggagtctcgctgtgtcgcccaangctggagtgcagncggctcaatctcagctcactgcaagccctgcctcctgggttcacactattctcctgcctcagnctnccaagaagctgggactgtaggcgcccgncaccatgcccggctaattctttgtatgtttagnanagacggggttncaccgngttagacaggatggtctngatctcctgacctcatgatctgcctgcctgggcctcccaaagtgctgggattatangcgtgagccaccacacctgnncataatgctgatattttagntcagggtcatgcnancaacattacagatgttgtgaangactacatgttcntttgtncnaattgtccctttaaaatnaggagattncaaacaaatatttgaagctctttgaggaggggcttttcagatttaaagtgataaaccttattagtntctctttaggcagagaactgaagatacatgtatatctcanctttgtgagtggaaattctctttcanactttaacattgaaaagttaattcnaaattcttttctcatatattcatgggccttggtaaatgatgggccgaanatgtcctgttaacttgagaaaaggagaaaaattnttt

SEQ ID NO: 2301 - DNA, 755 bp, Homo sapiens
  misc_feature (1)...(755): n = A,T,C or G
gntatncnttcaagctcttgttctttttgcaggatcccatcgattcgtgaaggtctacaacccagttagggcagaatggaggcaaatgaataatattcccttggtctcagagaccaacaactacagaattatcaagcatggccaaaaattgttgctcatcacctctcgcaccccacagtggaaaaagaaccgggtgactgtgtatgaatatgatattaggggagaccaatggattaatataggtaccacattaggcctcttgcagtttgattctaactttttttgcctctctgctcgtgtttatccttcctgccttgaacctggtcagagtttctcactgaagaagaagaaataccaagtgagtctagcactgaatgggacttaggtggattcagtgagccagactctgagtcaggaagttcaagttctctttctgatgatgatttttgggtgcgtgtaccgcctcagtgaaatgcacaggatcaacagggtttgntgtaactagattgaaacactaagttgtttttactgttttggaaaatatcttaaatatcctttttgttcctaaaggagaggaaaagttgattaacttctggtttggtttagaaaaagtaatgtttgaaatacgaaggtaatttaatgttacaaattttaacactcaaatcaaccttttaataattttctgtgctaagggtccagtattatttggattatttagtatggttatgtttcatgacactaatttagtctttgat

SEQ ID NO: 2302 - DNA, 729 bp, Homo sapiens
  misc_feature (1)...(729): n = A,T,C or G
tttaaaccttngaatcgcacgagaccgggaccagaacatgaccggctgggcctacaaaaagatcgagctggaggatctcaggtttcctctggtctgtggggagggcaaaaaggctcgggtgatggccaccattggggtgacccgaggcttgggagaccacagccttaaggtctgcagttccaccctgcccatcaagccctttctctcctgcttccctgaggtacgagtgtatgacctgacacaatatgagcactgcccagatgatgtgctagtcctgggaacagatggcctgtgggatgtcactactgactgtgaggtagctgccactgtggacagggtgctgtcggcctatgagcctaatgaccacagcaggtatacagctctggcccaagctctggtcctgggggcccggggtaccccccgagaccgtggctggcgtctccccaacaacaagctgggttccggggatgacatctctgtcttcgtcatccccctgggagggccaggcagttactcctgaggggctgaacaccatccctcccactagcctctccatacttactcctctcacagcccaaattctgaagttgtctccctgacccttctttagtggcaacttaacttgaaaaanggatgtccgctttatncaaaattacagctattggcaaataaaacgagatggataaaaaaaaaaaaaaaaaaacccctttaaaaaatttagnggagtcn

SEQ ID NO: 2303 - DNA, 778 bp, Homo sapiens
  misc_feature (1)...(778): n = A,T,C or G
gactatctctttcaactncttgtcctttttgcaggatcccatcgattcgaattcggcacgaggagagtggctaccttaaaaatgcntttnttgaagaactgtaacctcagaggagcaactctggcaggaactgatttagagaattgtgatctgctggggtgtgatcttcaagaaccaacctgagagnggtccaacgtgaaggggagctatatttgaagagatgctgacaccactgcacatgtcacaaagtgtcagatganaattttaggggctggaggaagatgtaaaagatgaaaatgttttccttatcacttttctttctccacccactcagttgtctagaagaaataacactgtaaggaaatttaaaaaaaaaacatttagaggattatgcttgttttgagtggtgcatangggaaaaaactgacttttttttccatattctgatttttaacagaaaagcactcatttaatagatgtanggaaactagatattgctgccttttgaatggggtaggggggtttacctggttttatgaccaggcatagtatctattatatttgcttttaaataggcatgatgtggaaataccatcttggtttgagatgcatttgaggattttaatttatggaaagccccaccatatgcaattatatttattggaattcctangatgcanntattggattatttnaaattggttaaaactttatgaaaactttgnaaaaaggttgttcangtttataaatagctttaagtgatgccctcccttntttt

SEQ ID NO: 2304 - DNA, 1609 bp, Homo sapiens
  misc_feature (1)...(1609): n = A,T,C or G
ncnnncgnnnnntggggntgncnnntnnntcnctccctncncggngggnggcnnggggtnntgtnanggantgcngntnnctntgcccnnccccnnnnnncggtgctgctcgangagncgccgaggatatctnnnnnnncccccccnttgcggcgnctcgggggggggggggggcgctttttttttanacggcnccnccgncacnggggggggggcntttncntgccnncnncgctacttccnnttttggaaccgngngngcnangaanngaagggcnnnangcgcgccggtgcnngtgctngtngcggncnggcgtngcgngtggtgcgnnnnggcanacgtcgcgncngnnngcngnngcatnngcnctngnncncgnggggcnntgtgtnnnntaatgancgcgnnccgnagacngctctgggactctgcnnnngggncggcggcgcgtangtagngcgctngtcggntngcngtctntangctcggagcnggagcacnngnnnncngatgacgnnttgcnngngngngctntngangccgtangcgngtnctnnnnggtagngnagngttcgactnngtcacgtgnagttgactctgtngnnngcnccgnactgnccnctgcgngntgtgngtgtnngctaacgtnnnnggantcngnaagtangangacgccggnngtgttgancgntgnggtcggngnanccggcngtnngggaagcgtggtggtnngcctcnntnnnggtgtgggagcnntcgnnagntganggnncgttgnnngnggctcggcnatcttccgggngcncncgtntncgatncgctctctngnttgntngnntgnnnacgccgcncgatgccgcgngnngcgcgacgncgctcgngngctgcgncgatatcgntacannaggggaatgggacataccgngnngntngtgcncgtctnangngaggnngangcgcgnctganatgaggngagcngngagtgtntctgannactggagcgcgcngtgcgnttcntcttccngacgtacatctcaccncgcncatcggtgcgcgcgctcggannaggtacgcgcnnntctngntgntnntnncantcnctcnnngnagnacgncnggngccggtanngagnncgntcnntcacgtngngnnnncgngacanagncncncacgatntgcnacgagcgcncntcaganngangtgctgatgtgngccacgnantagngtgcgtgatatnggcngtcatggcatgngtgcgtncagtgagcnngcnntgnntcntgcgtgcancgtacgnnacacgcgagacgntctncgngctgtgcacngcgcnncgngnntnataggcacacnggcatcnngcgnatantgctgaggggancgnctgcncgnaanngcgacgtnngntgnnnacanagacgcngtgatttcacgnggccggnggntgnntncgggctggnctgnnntgnngncgtgcgtccnagtcgcgntganacgnggcgtcnanagncgaatnggagccggncgaggngtagatggggacgggagntnatngacggtggccganacgtgtccgagcttcgcggctggtngngcaccggngcc

SEQ ID NO: 2305 - DNA, 1021 bp, Homo sapiens
  misc_feature (1)...(1021): n = A,T,C or G
gnggnanngannngnnangnaangnnagagnngnggnngnnnnnnnanggngnannnnnncggnnnnnnnnnnnnnnnngaaagaaccttgaaaaaccggcntntnngcagcacccangcgncganagngggnacgagggtcagaaaagaaaagcaaaaancatttnntgcggcggacacacgacaganngggggggggtgnnggagagacagngccgnnacgagttnctcgnnnccatnggggncaaaggagnangggnnagcgnnntcgctcanacgcngccgngcnggggtgacancngcnaggnggaaagnagnantaacnaagggtcgggnagtggaggntcancctggaganggnggctacnaaggggangcngngcacggaagngannaganngtccnggacaaanggaccgtgaccggcanacnggagangaanccggcaantancnganganctncngancnnagangcnntgtnncgcancggnngacgcngagnnnagnngtgnccgggntngaannaggaagnnggaaaaaggcnacgangngnngggnngggagcggnngcngaggctcgaagnantgnggcccgnngagcgnancgcatngggggnanngcannnagaacgaagagaatggtagggacncnnnaannggcgagggtntgtaaaagnnacncgnggaacgnggnnggaaangncgaganncgnggnanaccggggnggtgganaaatggtnnnaaanaanngccatgaggggcccnnnacannnccncccncaacacnnagncnngggcgcgaaagcantanggnatangnnnnnnagcacgtntagagtgnnaangagggggtnacaganaaggngccnganctcaaacaatagaaaaagggggcatngnannatacaggggggnctntanagattcaacgtcngnacggangcacacggtggggcgangcgnacacnggggngggtgancnanagtaccnagcgagngccgntgtgnnacnatnnn

SEQ ID NO: 2306 - DNA, 757 bp, Homo sapiens
  misc_feature (1)...(757): n = A,T,C or G
nttttaaacccctttgcgaaannagggancagtgtgtaaagtacaaaaaccagctggggcgtggtcgcgctcatggtgtggaccactgttgtttagactganctgggnanggatggcttgnnnccttgnaagnncaaaggctnttngtgatctttttgtttcncctcctgnactctancctgggttgacagancaagaccccatatcaaaaaanancggccgggcgntgggggctcacgcctgtcattccancantttgggaggctgaggcgggtggatcacaaggtcangagatcgagaccatcctggctaacatgatgaaaccccgtctntactaaaagtacaaaaaaaattanctgggttgtggtggcgggcncctgtagtcccagctactcaggaggttnaaggcaggagaatggcgtgaacgcgggaggcggacttgcagtgagccaanatcgngccactgcactncagcctgggcgacagagcatgaccccatntcaaaacaaacaaaactgtgatgataaaaagcgccataaacactaatttcaaaccatgctactctgtcttaaattttcaaatagctttgcacctgaaatacaaaattaagttttgggaaaaacaagtttttaactgngttgctcacaagctaattaaactggntaagttctgccatgtgaaagggtaaaaaaaataaagttcattttttggaaaaaaatacaaatctttctanntnttatatctttntncnttnnnt

SEQ ID NO: 2307 - DNA, 1175 bp, Homo sapiens
  misc_feature (1)...(1175): n = A,T,C or G
atgggggannnnnnnnnntnntnntttttancccgatnaattcccttnaannaatttccaagaaancccttngggccattggggccccttggggccaaaggggnaanacnaaaaacattncntaacannnngggntaaaagcaacaccncnannggtatancncntanaggnctctcnccnatatantgaagangganacatnatnnatnanngnaannaaatnttttntntnacaaaanntttcnacatggcggctcncntanntatnntaaaanagcnggngntatcatntatncgtgaaacaaananncntnncgntgatttaccccnaaaatataaaatctnaantncncnangnagaanactntnanttncaacaaannnntngtnattaancanaanannaacnntnannnnacngnttctnttncaanantatctcannnctaaaatangtnaaancnnaangcacctctgtnanngganncattaagcacanntnngttnantangagttacnntatatnacanaantngnatnaanttnntaaacnccntanccgacnantnaattnaacctaatatntcnatanattttcannncaanaatnannagatcnnatcnngnanancnnntaaaataagtgnnnctnacanatntnanntnannntgaanaattaacagngntttaaanngnanaccnnttgacccnctaaaaaaaaanctatttanntaaatagtnnatngngatttaaccanataatantgnaancnccatncacactnntagaatannacacacgggnnctataatacnctaacccntnttttanacaccatntctnctaanatantcacactattaaccaatanaaacnaagatcgggggaatatcatttgcncaaatcaaaanaaaatcngggataaccaaactactcnntaaaacaccttantgcggngggggnacananataanatttnganatctaaatnaaagcggaaanncatgnancccntttcccgcccctcttatttaacnntntaaangaaaagnnnaggcnttttctctctatnnataccancanctccnanantangtaaaaaatnantnanntgnagnaagagtttgggggntnnatnncccacnanacttttgnaagaangcngtttncg

SEQ ID NO: 2308 - DNA, 861 bp, Homo sapiens
  misc_feature (1)...(861): n = A,T,C or G
ncagncccantcaaagcncgctgcctgnaaaagacccatcgattcgaattcggcacgagnggaggaagcannagggaaatcntgacgctgcaaantgcncaggcncgaatacggatggtcctcgcctatntggtngctcantagaacctntggactnggggtgtccncggtgggctcctcgngctgggatccncnacgtggatgagagtntantgggctcctnccaaggccnntgtnccanttgcngacatcaacccttatgcngtatcacaagacngacctatnnggccttcttcnagntnangcatccncccgcttccagctntctgccctgcagagcatactgntggtgcctgacaccgcaaatctggagccnttggctgatgganangtgatncnataccgacnangaananatggggatgacatatgcananctctcnnantatgggaaactcaagatngtggcnaaagatggngccctacaanntggtntgcaaanttcntcaggatntngaaacacntctgccccccctgacangtcncnntcaaagagnaacnggngntntctttcaagttcttnccttgaacncganacaaagaaggactgacgctttncacaactgagtggcctacngcctnnanacatagcaatnccttgaangaacacaaaagggnttttgancgtgncgaaaccaatttcccttggnaccgaanccacaaattcttgngccccttagggaaaaagnttnttcangggggccnttaaaaaaaannaaaccanggggggccacaacnagccattggggaggccccttaataaaanaaacctcatataanccctnaaggtaacgtggaann

SEQ ID NO: 2309 - DNA, 777 bp, Homo sapiens
  misc_feature (1)...(777): n = A,T,C or G
nantattcgntcaacctnctngtnctttttgcaggatcccatcgattcgctgtaaatgacaaaagaaaaagaaaaattgagccttgggacgtgcccattnttactgtaaattatgattccgtaactgacttgtangtaagcagtgtttctggcccctaagtattgctcgccttgtgtattttatttagtgtacagnactacaggtgcatactctggtcatttttcaagccatgtnntattgtatctggtntctactttatgtgagcaaggtttgctgtccaaggtgtaaatattcaacgggaataaaactggcatggnaattatttttttgnntgttntttgttttttggctctttcaaaggtaatggcccatcnatgagcatttttaacatactccatagtcttttcctgnggngntaggnctttattgntatttttttcctgngggctngggtgggggtttgtcatgggggaactgccctttaaatatttaagtgacactaccnaaaaacacaaaacggtgatgggttgngttangcttgnatngaatgctgacttgacatctnttgccttgacctccggtatgttntaaagctgnntntgaanatctggatcttgcccatcctttgggntagngccnggnctaattaaatttggctttnttccaatttttttttacttccctttnctccctttncnggaaggcattaaaatgctngntgcctggggtcttttaanaaatgttttaaaccattttccntggnagnaaanaaattt

SEQ ID NO: 2310 - DNA, 1391 bp, Homo sapiens
  misc_feature (1)...(1391): n = A,T,C or G
gcnnnnngcnnacnngnngnnngnnnncnannnnnnnnnnggnnnngnnnnnnnncnnnncnnnccnnnannnngnngnnnnngcgcgnnncnanannnnnnnngngcncgcgnncnnncncnnggcgnnngnnnnnnnncncgcgnncnnncnngngcgcnngnnnantcgcgngannngngnncgcncncacgngcnnnnanncgnnnncnngcncnngcnnncnnnncccnccnagnntngancaccttccntntaaaaccaanncnncccccncntnngngggtngnannngnancgcangnccccannccncnnnnngcggnnngggncnngngngngggnggngggcgagncnannngtnttttttttnngcgntgccnannccggggncngangacgacgggggggggtgncgaanngncgnggcnccgcggggtnngnngcgttangcnnccnacaanggcggcncgancgggaccgngcncngtnannggngncntganncngnaanacgcagngtgcgngacacggnnacnacgtcgangagtgnnnaccataaggagangggnngggncacaggcgacgngnnnaggnagggaagganccngnnggcggngncngncnngacnacncaccngncgcggcgcggnacnncnncgacancnccgganacgcggngcggcnacggcgngcgnngggngacngcacggnnanngncgncncacnaggngncancgnnnngcctgggncgncncngnnntgncncnanggganggtnncncaannnggncgagcanggaagnngacgacanataantcgggaacngggcnannannggngnggggggnnggcgcgnggccaggnagcggncatnncgncnanannngnacaangggcnnnangcnnccatgnnangggggaggggccncacgggaggggcgcgggaagacnacccngggngggnngacngggangnntatgggnggaccnngnccntgggcnccaagcaangggnggngnaccccnnggngctcncncgcctcagnaaaantnccngnanangntnangccccacgggcggncgngtgggngngggggacgccccnggtananccccnnggntancnctctaggaagggcnggacgggccnggggaggaaaancnctngggcaaccccggggganggccgggannggcnggcacgnagnggcccgnngaatganacacccagcgcggnncgncncangaccnnggggcnancnngngnccaagganctnctggncgccaggcggggcaaggtgaggggngtnccacncgnanaaagacgagggggcgcggcgccgcgcgcangncnggggggngggggccgatgggccggnnnng

SEQ ID NO: 2311 - DNA, 736 bp, Homo sapiens
  misc_feature (1)...(736): n = A,T,C or G
nntttaaaccncgnatcgcanacagccaaacagaccttctgtttcatgaacaggcgtgttatatctgctaacccatatctagggggcacctccaacggctatgcccaccccagcgggacggcacttcattatgacgatgtcccgtgcatcaacggctcgtgggaaccggaagacggctttcctgcttcctgcagcagaggcttgggagaagaggtgctttatgataacgcaggcctgtacgataacttgccgcctccgcacatctttgcccgctactctcctgctgacagaaaggcctctaggctgtctgctgacaagctgtcctctaaccattacaaataccctgcctccgctcagtctgtcactaatacctcttctgtggggagggcgtctctcgggctcaactcgcaggtacggcatcttcttctgtaagattctagaaccaccttcaagtcacattgctccaacagagttttgcaacttgtagtaaatgggactcatcaaaggcaaagcataatgtgttnttttttctcaactagaatataatttgcagcctgactaccaaggaactgatgaaatatttcttaacgagctcatggnttatctgancactgtgtttntttgcccacatntggctctttttctgttnttggaaaanttcccccantgaaattttngngaattatgtcaacttaaanggcagagaagtttnaaaagaaaccgggttataaaactt

SEQ ID NO: 2312 - DNA, 774 bp, Homo sapiens
  misc_feature (1)...(774): n = A,T,C or G
tcnatncgntcagctcttgttctttttgcaggatccctcgattcgaattcggcacgagaaaaatatgggctgggattacaggcgtgagccaccacacccagcctttcttttagtgctttaaatatattggccctctgccttctggcctccaagtttctgatgaaaaatctgcttgtcattttattgaggatcccttgtatgtgacaagtttcttccctcttgctactttcaggattctaactttgcatttcaaaagttagactataatgtgtctcagtgtgggtctctttgagttcattttacttggagttacttgagctgcttggatgtttatatgcatgtctttcatcaaatttgggaagttttcagccattatttcttcaaacatagtcataagctgcataatgacattttggtcatcaatgaactgcatatatgatggtggtcctcaaagattataatactgtatttttactgnactttttatgtttatatgtacttagatacacaaatcttaccattgtgttataattgcctaagtattaaatacagtaacatgctgtcatatttgtagccttggagcaataaagttatataccatataagtttangtataccagtagcctataccattgtaggcttggtataagtactctctacgatngttcacaccaatggttggaaaatcacatgaaggatgtatttcctcanaaacatattttttggttggttaaagtggatgccatgaactggtanttcttctcttgncccttt

SEQ ID NO: 2313 - DNA, 729 bp, Homo sapiens
  misc_feature (1)...(729): n = A,T,C or G
nttaaaccccnttcgattcggcacgaggcgatgnnnnatnctgntnaatgtncctnncantntnaccnnacggntgnacttcaatgtnctngtgaannactcacncagggatcgcctcgccntnnaggncgtgannatnaggtgnncaatagnntgtgacgcaccgtgcaaggnaatgnncggcaagcatctgggnnaaaanaancntacnctttggctgctcttgaagaatgaannacgacgncncctngcngaacnagaagcnttngaaaacagactgannggnccncggangaagaactggacntgngntgatntggcangngagcnatcactatggggnaaacatgactattatntcnttnnngnnngtgcnntngngncngtngngtnagccnngctcatcanncannatggcannnnnnaantgntgggntctttcacngncnntnncnttggntntntannantngttcnanccngnntattncaanntgncttttntngannatgntntatattgacatncatntgngnattctntnaggtntntgtgaganggacantntgtnaaactctatcttanntntngtcctntgaccgncacctanagtantgtgtncaagtggacncctgactgaaactaaaanttntgntaccgcttagcttantngctgacttacntncttttggncattgggctnccctgactttcctntcatttaatca

SEQ ID NO: 2314 - DNA, 760 bp, Homo sapiens
  misc_feature (1)...(760): n = A,T,C or G
tattatncgntcanctacttgttctttttgcaggatcccatcgattcgaattcggcacgagataaaacaggaattttggagcgggttgaccgaaggttagtgtacaaatttggaaaaaatgcacacgggtggcaggaagacaagctatgatctgctccaggcatcaagctcattttatggatttctgtcttttaaaacaatcagattgcaatagacattcgaaaggcttcattttcttctctttttttttaacctgcaaacatgctgataaaatttctccacatctcagcttacatttggattcagagttgttgtctacggagggtgagagcagaaactcttaagaaatcctttcttctccctaaggggatgaggggatgatcttttgtggtgtcttgatcaaactttattttcctagagttgtggaatgacaacagcccatgccattgatgctgatcagagaaaaactattcaattctgccattagagacacatccaatgctcccatcccaaaggttcaaaagttttcaaataactgtggcagctcaccaaaggtgggggaaagcatgattagtttgcaggttatggtaggagagggtgagatataagacatacatactttaagattttaaattattaaagtcaaaaatncatagaaaagtatcccttttttttttggagacgggttctcactatgttgcccagggctggtcttgaactcctatgctcaagtgaatcctccccctcggcctnccaaagt

SEQ ID NO: 2315 - DNA, 737 bp, Homo sapiens
  misc_feature (1)...(737): n = A,T,C or G
nannatccgttctccgcntgctgcctgnngcangatcccatcgatnccgaattccgcgcgcnngcaatgtatccntatgccnantgtngttgcantancactggancgagggtttacnangcggtgcntgnnaaaacccnntngttacccagnnaaatngacttgcaatacattcanctagcgcgcgnntgnnntcataattcantgggnnntatccnatcgcncttatcaangagatgnctctctggctntctnttgcnctctcantggaaccggnnattgnatannaaantcntgntnncaanctcnntctccctnatnggngacngcaactacctaatcttgaacagatatgctaatttcgctaacnctcnggtctgccctncccgatcccctggctncncagnacacattccnntgaantaaggnttcnanatacatgnncatnctatnnntatnnnnggcaacntgnattagggtgantntatanntatanntncatatgcntgatganagctgataanntnnacnttgntattcnncgttctatatgagannactctcgtgnaaactggacaacctcancctanatctggctntttttaantttaaaaggntatcacgaattcancgagcnctgaaaatccgctanttgcnggaannnactcgacattcgcatntgctncgcncacatttccngatnngncgntcacntcantntancnngnntacacncn

SEQ ID NO: 2316 - DNA, 728 bp, Homo sapiens
  misc_feature (1)...(728): n = A,T,C or G
nttnaacccctntcgantcggcacgacagcatctttcaggtcatccggagctgcaatcgaagtctggagacagacgaggaggacagccccagtgaaggaaacagctccaggaaaagctccttgaaggataaaagccgatggcagtttataattggagatttgttggattcagacaatgacatctttgagcaatccaaagaatacgactctcatggttcagaggactcacagaaggccttcgaccatgggacggagctcatcccttggtacgtgctgtccatccaagccgatgtgcaccagttcctgctgcagggggccacggtcatccactacgaccaggacacacacctctctgcccgctgcttcctccagcttcagcccgacaatagcaccttgacctgggtaaagcccacaactgcctccccagccagcagtaaagcaaaacttggtgtacttaataacacagctgagcctggaaaattcccactactgggtaatgctggattaagtagcctgacggaaggggtcttggatctttttgcagtgaaggctgtatacatgggccaccctggcattgatatacacactgtgtgtgttcagaacaaactgggtagcatgttcctgtcaaagactggtgtgacattgctctatgggcttcagaccacagacaacagattattgcacttcgtggcacccaaagcacacagctaaaatgctctttagcggat

SEQ ID NO: 2317 - DNA, 750 bp, Homo sapiens
  misc_feature (1)...(750): n = A,T,C or G
antttgacccctttcgantcggcacgagacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagggagaacctaaagaagtagttaaacctgtgcccattacatctcctgctgtgtccaaagtcacttccacaaacaacatggcctacaataaggcaccacggccttttggttctgtgtcttcaccaaaagtcacatccatcccatcaccatcgtctgccttcaccccagcccatgcgaccacctcatcacatgcttccccttcacccgtggctgccgtcactcctcccctgttcgctgcatctggactgcatgctaatgccaatcttagtgctgaccagtctccatctgcactgagcgctggtaaaactgcagntaatgtcccacggcagcccacagtcaccancgtgtgttcccgagacttcttcaggagctagcagagggacangannaagaggatccccagggtgacagtaaaacaagcaaaaatgggnccaccaagaaaacacaattgtggagccgcttntacagaagttttattcatnttacccccttcacagnggatnccagccaagaaaat

SEQ ID NO: 2318 - DNA, 756 bp, Homo sapiens
  misc_feature (1)...(756): n = A,T,C or G
nttatccttncaactcttgttctttttgcaggatcccatcgattcgaattcggcacgagaccacgtcatatacagcctacaaagagctcttgactgtgagctcgcagaggcccagttgcataccactgccattgacaaagagggtcgncgggctgttaaagcgggagcttatgctgcttgccaggaagcaaaggaagatataaagagtcattcagaaaatgtctctcaacatccacttcatgtagaagtattacactcagagattatggctcatcagaaatttgctttgcgtctnggttcctggatgaacaaaattatgagctattcaagtgactttaggcatatcttttgccaagcatgccttagagaagaacctgactcggagaatccctgtctcataagcaggttaatgctttgggatgcaaagctttataaaggtgcccgtaagatccttcatgaattgatcttcagcagtttttttatggagatggaatacanaaaactctttgctatggaatttgtgaagtattataaacaactgcanaaagaatatatnagtgatgatcatgacagaagtatctctataactgcacttcagttcagatgtntactgggnctactctggctcgacatcttattgaaaacagaatgttatctntgtcattactgaaactctgntntaagttttacctgagtncttggacaggaacantaaattcnacttccanggttatgccnggacanattggnaagatt

SEQ ID NO: 2319 - DNA, 760 bp, Homo sapiens
  misc_feature (1)...(760): n = A,T,C or G
atatccgttcaactacttgttctttttgcaggatcccatcgattcgaattcggcacgaggagttctacaggtggagtgtggggcccagaaggggctcaggtcttaggggtgtcatctgaaaaaacagagatggtgatgggacaccagttctaggagccctctgcatggccactttctgcctcagctcttctaaagcatttcttctgttcccttccattggggtaaccactgatctgtcttcccaaaaactgagtcagaagttggactttgttacttggctcatctacatttaagatatagtcagaaaaaaaatgcagtctttacatcttaagaaagcttacatgggccaggcgcagtggctcacacctgtaatcccagcactttgggaggccaaggtgggcggatcacctgaggtcaggagttcgagaccagcctcaacatggagaaaccccatctctaccaaaaatataaaacttagccaggcatggtggcttgctcctgtactcccagctacttggggggctgaagtgggaggattgcatgagcccagaagtgggaggttgcagtgagctgagacgagatcgcaccactgcactctacctgggtgacagtgagaacttgtctcaaaaaataaataaataaataaaatccattaaattgccaaaaaanaaaannnnnnnnnnnnnnnnnnnnnnnnnnnnnnnnnnnnnnnnnnnnnnnnnaactnggcctttaaaactttngggagncnnttncntan

SEQ ID NO: 2320 - DNA, 732 bp, Homo sapiens
  misc_feature (1)...(732): n = A,T,C or G
tntttgacanctttcgantcggcacgaggaacatatgaaaatacaacttaaataataaacagtggaatataaggaaagcaataaatgaatgggctgagctgcctgtaacttgagagtagatggtttgagcctgagcagagacatgactcagcctgttccatgaaggcagagccatggaccacgcaggaagggcctacagcccatttctccatacgcactggtatgtgtggatgatgctgccagggcgccatcgccaagtaagaaagtgaagcaaatcagaaacttgtgaagtggaaatgttctaaaggtggtgaggcaataaaaatcatagtactctttgtagcaaaattcttaagtatgttattttctgttgaagtttacaatcaaaggaaaatagtaatgttttatactgtttactgaaagaaaaagacctatgagcacataggactctagacggcatccacccggaggccagagctgagcactcaacccgggaggcaggctccagcctcancaggtgcngagcccgtcacttgcaccaagtctcactggctgcagtatgacatttcacnggagatttcttgntgctcaaaaaatgagctcgcttttgtcaattgacaggttcttttttcttactaaacctgtactttttgtaaatacacatagcatgtaatggtatcttnaaagtgtgtttctatgtgacaattttgtacaaatttgttattttccatt

SEQ ID NO: 2321 - DNA, 1025 bp, Homo sapiens
  misc_feature (1)...(1025): n = A,T,C or G
aacnacctttnaactcntgtcttttngcaggatcccatcgattcgaattcggcacgagnggaggaagcacnagggaaantttnncgcngcaaanngcncagncncgaatacggatggtcctcgcctatntggtnggctgantagaaccaatggactngggggtgcccacggngggctcctngngctggggaatccaanaacnagggattnaataaganctaccntgggcntncccttaccaaanngccnacttgcttccatttgncgngaaccntcaacccccttgtatggnccggatatncaaactaangaacnggaaccctaaaagggnccnntncgtcccannntnntngnaantccccanncggctttccnanccttttccttggccccctcgcnggaaggcaattanctgntttgggcccccctganccaacccnttnaaaaatccttgngcaggcccctnncnggccattgaatnnggaccaccggtnggnttccncannanncccgaaccgaaangggaaanaaacatgggngggtaaangaaccnttaattgccaggnatccttcttttnggananttaatgggngaaaaacctcaaagnaaanngntgggcccnaaataattgggggggccccttaccaaaatgatggtttnttncnaaaactatcctacantgattgctnnaagaacacaatacctggcnccccncgcaggacaangtcaanttgctcnaaaagangaaaacnggttntntctttcaagntacttcctttggaacncgncncaanggangaactcgaancttctacaacaanttcngtggcnnncagcccttaagaacttnncganngccttgaaagnaacaaanaaagggttttgaaccgtgctnaancaatttncctggaaacgatccananntcttggcccttggcaatgttttcaggtgccntaanaaaaaacagggtggcaccaagcattggagccttaanaaaaactaataacctaagtangttancan

SEQ ID NO: 2322 - DNA, 717 bp, Homo sapiens
  misc_feature (1)...(717): n = A,T,C or G
cggagatatgattaggagagggaatgctttttgagggcagaattgccaatctgcttgtactttataagcctgttgattgtttagatacggtttagccagtttatagttaccctgggtgctgaaaggtatgctggatgatacctaaccaacagagaaccattgaatgccgttcaaaatggactgaagcatcagcaatgtctgaaaaaggcctgacagtaatgtacatgtcaaatggcccgtaatttaagcagagtagagtaagtagaagaataaacatggggaaagttccagcaacagaggaggctttgagcttttgctcttcatcttgagtggatgttgttctcaggtggtaataggccatcgagctttctccactggctgnctctctggggaacaaataacccgaaaagatactcagcaccctggttggtacataggtggtcagttgatttatacttcctggttttcagtgttgcttgaattttctaaatggaaacacagtacctttataatcagaaaacaatcccnagttttgatttgagggtgttgtaaaaaaggttnatanttttntattataataagctccncngnccntnttaaaaaacnttttggggggncgntnttangntganaatccccanancttgannnagatatanctttgtnatgtngtttgngggnanaaaccncnctctctnanaatatatntnctnctcg

SEQ ID NO: 2323 - DNA, 773 bp, Homo sapiens
  misc_feature (1)...(773): n = A,T,C or G
gtttatccttcanctcttgttctttttgcaggatcccatcgattcgaattcggcacgagggatagcccacctcatgttcctgttcctgaactctcaacagacactgttataaatgtgatcactaatatgacaaccaccatncagagtctctttccaaatctccaggttttccctgcgcttgggtaatcatgactattggccacaggatcaactgcctgtagtccaccaagtaaagtgtacaatgcagtagcaaacctctggaaccatggctagatgaagaaagctattagtactttaagggaaaggtggtttttatttcacagaaagttacaactaatccaaaccttaggatcatcagtctaaaacacaaacttgtactacggcccaaatataatgacactgaacaagacttgacccagccaaccagtttgaatggctagaaagtacattgaacaactctcagcagaataaggagaaggtgtatatcatagcacatgttccagtggggtatctgccatcttcacagaacatcacagcaatgagagaatactataatgagaaattgatagatatttttcaaaaatacagtgatgtcattgcaggacaatttatggacacactcacagagacagcattatggttctttcagataaaaaaaggaagtccagtaaattcttttggttgtggctnctgctgttacacccagtgaagagtgttttagaaaaacngnaccaccnatnctggtatcagactgtttcaantatgaacctcgg

SEQ ID NO: 2324 - DNA, 733 bp, Homo sapiens
  misc_feature (1)...(733): n = A,T,C or G
ctttnaccttntncgantcggcacgagggatagcccacctcatgttcctgtacctgaactctcaacagacactgttataaatgtgatcactaatatgacaaccaccatccagagtctctttccaaatctccaggttttccctgcgctgggtaatcatgactattggccacaggatcaactgcctgtagtcaccagtaaagtgtacaatgcagtagcaaacctctggaaaccatggctagatgaagaagctattagtactttaaggaaaggtggtttttattcacagaaagttacaactaatccaaaccttaggatcatcagtctaaacacaaacttgtactacggcccaaatataatgacactgaacaagactgacccagccaaccagtttgaatggctagaaagtacattgaacaactctcagcagaataaggagaaggtgtatatcatagcacatgttccagtggggtatctgccatcttcacagaacatcacagcaatgagagaatactataatgagaaattgatagatatttttcaaaaatacagtgatgtcattgcaggacaattttatggacacactcacagagacagcattatggttctttcagataaaaaagggaagtccagtaaattctttgtttgtggctcctgctgttacacccagtgaagaagtggtttagaaaaacagaccaaccaatcctggtatcagactggttcagtatgatcctcg

SEQ ID NO: 2325 - DNA, 897 bp, Homo sapiens
  misc_feature (1)...(897): n = A,T,C or G
atantccntctaacttctgcctgaggtcgactctagaggatccccggtaccgactngaaanaaanatatattgagccttgngacgagcccatntctnctgtaaatnangggntccntttctgactagaanncnncagtgtntctnggcccataagtnttgctgcncttgcgtnttttattttagnngtncatgaacctacaanggtggcgtcacttctgggtacanttttttcaaaccacatngttttcantcngccnttntngttgntcctaaacttgtaactgccccacnctnanggctgnnggccnttattnnnaangggcngtcanaaanttnttttngatngccngnngtnaaaattaaaaaaaaancttngggccaaanggggggtaaaaactctncattttgtcttcttnnggggttctcngntttatttcttttngncccggttttncccgngnncttcccttttttccaananagngntttatatgggtgtccccctatccccaatnggaagccagtcccgggttanaccancncctcccattaaccncctttattaccccnggngggncgtccncggttcagggnattcccaaatttanttgnttcttganggggccnttggtncngnaaaaaanctttggnggggcctgtnnctttcaacattattngggcnntcctctnaaaaaancnngtttttnngccntttgnccgtgngaagccccnntttttanncnaggggnnnnttttttnnacttggganaacnattancctnntntgggtatttnttggntanacngantttgcnntttcgctttggtaaaannactnttacaaaantaccgattacaaattacctcattctgnggnatgcacntctgggagnttn

SEQ ID NO: 2326 - DNA, 874 bp, Homo sapiens
  misc_feature (1)...(874): n = A,T,C or G
nctctncttanataatnttatatcnantttattattttanntnnatctcttnananannntngtnttannntngttannnttactnnttannancnnnnnnnnntnntgaaccccttaaaacnnnncgagtnanantcacanatgactgnncgatatagnaaagctatgtagacatntttggagctcttactgtnctaaactgnacagctgtgcttaaaacccttatttcatataaatggccttaagttttctaattcaagcgggtttttggaaaaatntatggtctccattaaaatacatattacaactggggtagattatttgtggtccagtgtctgtgatttaactttgcgttttgctatctgatttttatttttcacaggggctaagcatgagctttcattctcactcactcttaatttgtcgagcgtcactacacatgcaccgtgttgcagtcccttgaggccctgtnntgttaatctgtgatggagtgtgaattgtgtaacgggcactgngtttacactctcaggtgtttggcggggccggtcgcagacttcaatggtcccctnacggaaaaggccaggctncgngtggacggccaaacttncctgccccgctccttcagcangtgactgtctctgccantttcttacctggctgaaggattcttgctcaagtaagctggaacaaatgctgcttgtcacacagnctttttctnttgaaactttnangaaggctcccttngtncaccaaggcaantggggagcttgtagaaccaacccgnannccactttgccccacaattcanttgctnacctggcnttcaactgngaaataangtttaaaggtncacccggggactttctncttaag

SEQ ID NO: 2327 - DNA, 730 bp, Homo sapiens
  misc_feature (1)...(730): n = A,T,C or G
ttgacnccnttcgantcggcacgaggagctgatcctgcatcatgcccgggccagcgagtgcagggacgtggaggggttcaaaaccgagatggccatgctggtgacccaggccaggaagaacaccatcaccctggagaagcttcatgtgtccagccttctctctagtgtctttaagttgctggatgactcacaaggtaaagcttgagagcaactttgcctccattgtgtttgccatcatggtgttggaggggcttggccgctcactggaccccaaactggacatcctggaggcagcgaggcccttctcctcacggcccagtgtgccccccgtgatggggcagtggcctctgtgggcccttgtcaagagctggaggccactcccaagagcctctcctatggcagctgggacgttttaaaattgggacaccaatttcaaatgtaaccctncagtggtggaaggcacaccatggcttctctgcttggtttgagggtctgttcaaaagctttgggccaattagggagtaaaaggagggaaggggcctatccattccattgtggaagctgggccaggtgccagggacactctccttcagggaaaatgttatgtggaggaggacgaataaatttattttgttttaaaaaaaaaaaaaaaaaaaaactcgnncctttaaaactnttaggggagnnntnttaccgtaaaatccanacttgataaaaananattgatgaa

SEQ ID NO: 2328 - DNA, 855 bp, Homo sapiens
  misc_feature (1)...(855): n = A,T,C or G
nnatcctntctcagcttgctgcctgcaggtcgactctagaggatcccctgtacacgagctccaannnancctatantgagccntnttacaannccnctggncgccgtaaancangggntnngaatntgannaanaantangcaantgttnctgncncntaagtattgctgncttgcctattttactagtgtaccnatactacaagngcgtactctggtcntttttcaacncatgttntatcgctcnagttttctactttatgtgagcaagggttgctgtncaaggtgtaaatattcaacgggaataaaactggcatgggaaatttttnctacgnccnnnncncnctttttgnctctttcaaaggttnatnncccatccatgancnnnnttttcccnctccaatntttaaatcnggggcncccttnagggtatcnannntangngttctgngggctggggtgggggnttgtcntgggggaactgccctttaantnttaagnnacactaccagaaaaacacaanaaaggtnatgggnacngngtgnatgccctggatttggaaaagctngggnctccgancntcttnttngnccttgggncnnacggntatnantcttannagctggggtnttnantttcttggnaancttggnnccgnntcaatttttgngctttttnngaccccnggntttgatttaaaaaaangggtgctcttnccatttaaccnaaaatacctttanccttctaaattcctttnccntnnaaaggctntcccctttgncagatncncgngggacnccgannaanttgntccntaacccantttttgatgggggggtatatanaaccccatntt

SEQ ID NO: 2329 - DNA, 1194 bp, Homo sapiens
  misc_feature (1)...(1194): n = A,T,C or G
gatnnntnaaacnccccttntttnnccaaaaanccttaccctgggtgtgctttttttttggnnnaagggnaaaccccccnatccggaatntncncnncatatcntgngnaaccggaatnccatctcaggactacacatgtatggagaanatgaccgcatatnttttttattcaaancgcctacatatatatcacctcgcaccagacagnggggggttttnttntnntnaacnaanngcnaggntaccnctnactgangaagnaaaactaanaaaatnnatccacagtaatananaaaaaaacnnatgnatcaannngnaccagaatancaagcnatancancanccaacananannaganactnnngaaaaaacanaacacccntnntacnaanaaannacacgannntanaattgattacagacgnaaanncantnnaaaaataaccatnccttatcntantaaanttcaaaaanntcntacaaaaaacannaatangantaaaacnaanttcncannnaganagnanagaaanacgaaaaatanatnnncattanncgntnnanctatancacanaacnctganaanncccaaantatgnaaataaacttntntnntncaaacngnncatncgancnntgaaatnancatactaatntanaaaanncnccanatnanncactaaaaaatnnacanaataaacnacactanancgtattnangtanacantnaacnatngnganntgatcctncacattatntacnacataacacatanantgtnntncttnganancattnacanncgnnacatatatagtatnnatactcatnaccgtnncannatatntaacactcgatctaaanagatacatatncaatanangaaatagaaactnaatanatnaatatcgagaggatctanntntaagcaaaactnanantatcncttangtncataaannatngtccnactnanctatcaacataanatagnntanacattttacctctaccgcgngcgttcatntatcaacacacaataattattcgcantnatntactaaaaaactccnnnatatntnctnccgacatnanatatctgtaaagaaatgtatactactancgcntngaanatctatatgatcacnttaacnctnacgnnangtaanatntatnttntnncnnncgt

SEQ ID NO: 2330 - DNA, 727 bp, Homo sapiens
  misc_feature (1)...(727): n = A,T,C or G
ttnancaccgntcgaattcggcacgagcacaggcccttttgtgatgcgttccacgtgtaggagatgtggtggcccgcggctccatcatcatatcgccctgtgtggtctgcaggggagcaggacaagccaagcagaaaaagcgagtgatgatccctgtgcctgcaggagtcgaggatggccagaccgtgaggatgcctgtgggaaaaagggaaattttcattacgttcagggtgcagaaaagccctgtgttccggagggacggcgcagacatccactccgacctctttatttctatagcccaaggctctctgactgactccgtcccagatcttctcagcttaacggctgaagactgacactgcccgatcgcctcagaagcccccgaccatcacggatgccgagcttcgggtaactctcgcagtggaaggatgcttcttatggtcaaagacattcatcttcctgataggaatgaagtggaaagctccagcaacaacagtcaagtaatggctggctcttcacttgaaaattatacaatataaaaaccgtgtttatgaactctttataatattatctttattatttctataaaagcagaatagcatgtgtgtatgtgatttaattctaactgtgcaaataaaaccattaaaaccaaaaaaaaaaaaaaaaaactcggccntttaaaacttttgggnggcntttccgtaaatcccaacctgaaaanatcctt

SEQ ID NO: 2331 - DNA, 1120 bp, Homo sapiens
  misc_feature (1)...(1120): n = A,T,C or G
nttatncgttacaagcncctggctntttgcgcganccctcgattcncattccgngccagggggngggaagaaattncccnnnaattgggtgccnncccntaaagggggcnncttgggcgcggcccnccttaaccgtgngatgggaananccggagnataaggaaggtncctannctnggtgggntccttataaaatttcctcnngatnccttggagaaggcggacntcanngttttanancagnttattgtcngtccncagatctctaaatncattttggganctancttttgacccctttaggtcagaaanaaaatcttgggaagcctggggctttcctggaagggtcaaagaaggtaactttcaggggntttaagccagggaattgggccattatttgcaccacccttaaaccctttccggannatccattcaagcctggcccttttcaaaaccatttttaaatttngggcccaggggtttattggaattgggncaaaaaaaattcccaggggaaattcancccttcaagccaggtttaaaattaaaaaanttaaaaattaaattnttttggggnccnaattanttggttacccccggaaaaatttttccccaaaaatnggggaaaagtnggcctttnttccttgggggagggagggcccaggaaaanccantgggaatggggacccnaaaagggggtttccggaagggaaaaaaanccaaancctttncccncccccttanttggnaaaatttttgggaattttttttttcccaaaaaaagggttcctttantttnggggnaaattnccccttccggtnccttgggtcctttnccccgggaaancccncccnggcccccggttnntttccanccaaggnaaaacctttttntttccaaaaaaccccttgggggggggaatgggttccccttantttttgggaatgggnttttttttggccttnggggggggtttngggggnccccctttttgggnccnnttttnccccggtttggncccaaaagggaaaaaaaaacctgggccncctgggttntttttggnccccaatnggaatccttccaaattcccctgggnaattccttccatttaaaaatngg

SEQ ID NO: 2332 - DNA, 720 bp, Homo sapiens
  misc_feature (1)...(720): n = A,T,C or G
nctaaccnttttcgaaccggcacgagggccagncagctgctcacactgnacaccacctctatnntcctgcgcctntgacctgtcgcctcctgcccggacgcccgcctgctgncngnntgcgagggcggatgctgctgntgggacgtncggctggaccacccccaaaagaggagggtgtgtgaagtggaattcgtnttntctgagggctccgagcatntggacggagagtggatgggctggcatttgtgaatgaggacatcgtngcctccaangggagcggncngngcaccatctgcctgtggagntggatgcaaatntgggggggacgnggcaancagnacanaatgncattggnggtncttgngctgctgcnatgganagccaccgatttgcctacttatcctcagaccctgnnctgataaggggattgtgctctgaggggatgatacggcaacntgtggctctacgatgttaacgaaatnctgaagcangacaccnctgatgctggtanccatgtnggntgcacacagatactganatgnncccaaccccttggcccttgnccaagtggngaccaaaaccatggtnaanacantgggtgganaatgnntcttcacatacctgnacgacatganggactacanaatttaccatctggnggangatgtagacntacaccatcccaaaagnaccnnngncacannttantaanttattnnt

SEQ ID NO: 2333 - DNA, 789 bp, Homo sapiens
  misc_feature (1)...(789): n = A,T,C or G
cctaactctttcaaccccnggctttttgcaggaccctcgattcnaattccgcacgaggagagtggcnccntaaaaagctttttttgagnaccgggacccnnaaaggaccaccnnngncaggaccngattnaaagaattntngaccngccngggggggaccttcaanaacccancctgagagggtccaacgngaagggagctntntttgaagagatgctgncnccactgcacatgtcacaaagtgtcagatgnagaattttagggctgganggaagatgtaaaagatgaaaaatgttttccttatcacttttctttctccacccactcagttgtctaagaagaaataacactgtaaggaaatttaaaaaaaaaacatttagaggattatgcttgttttgagtggtgcataagggaaaaaactgacttttttttccatattctgatttttaaccagaaaagccactcatttaatagatgtaggggaaacctagatattgctgccttttggaatgggggtagggggggtttacctgggtttttatgacccaggccntaagatctattatatttgctttttaaataggcatgatgtggaaataccatcttggtttgagatgccattgaggatttttaatttattggaaagcacaccatatgccattatatttattggaattcctanatgccagtattgggntatttaaattggtnaaactttatgaaaacctgggaaaaggttgttcaaggtttataaaaagccttaagtgatgccnnccctctttaaaanct

SEQ ID NO: 2334 - DNA, 794 bp, Homo sapiens
  misc_feature (1)...(794): n = A,T,C or G
ctttgaaccctcgantcgcccgcacganggatttcttggtgntggggacctattntcanngctttnggcntntggntaccnggggttnnagattangggcctttnatacctnnngnnccnncaaatttttttgncggatnaagatngtntgttngtanctaangtnaancttnnaaccngaccctcntccngttttantaangnntttttgcaacctnctggtaaatngcaaaatcaatggccaatggttaaccaaagaaggaaaacgttggggtgggactttgtctcttgcaccggtatttcaggaacaatctggcttgccatccccacagctctttaaaactggctatttatgtgtgcctttcattcttacatttctaatcatactgcaggaaaaacattggattcagctttagactganggaaaactctccattatgttgtaaagaaattatagatgtttgagagacacttttttgttaaaccagatattggactccagcaactattggggggtatatttttagttcattgntctcatttaatggctaaaatatccctttatatttggcttttaaataaattttcctttttttcctttttttttttttttaaaccgggagncntcccttnttgtttncccagggcttgganggggcaaggggcaacanaaacttnggggttttttggnaacccttttgnttttncccangggtnaaggccggaanaatnccggganttcagccctttcgggagnaagggggggcnctttcangggggcgtggccccnctng

SEQ ID NO: 2335 - DNA, 729 bp, Homo sapiens
  misc_feature (1)...(729): n = A,T,C or G
ntttnaaaccccctttnnnaaacangggaacagtgtgtaaggaacttgtgcacatcactgactggtaccccactctcatttcactggctgaaggacagattgatgaggacattcaactagatggctatgatatctgggagaccataagtgagggtcttcgctcaccccgagtagatattttgcataacattgaccccatatacaccaaggcaaaaaatggctcctgggcagcaggctatgggatctggaacactgcaatccagtcagccatcagagtgcagcactggaaattgcttacaggaaatcctggctacagcgactgggtcccccctcagtctttcagcaacctgggaccgaaccggtggcacaatgaacggatcaccttgtcaactggcaaaagtgtatggcttttcaacatcacagccgacccatatgagagggtggacctatctaacaggtatccaggaatcgtgaagaagctcctacggaggctctcacagttcaacaaaactgcagtgccggtcaggtatccccccaaagaccccagaagtaaccctaggctcaatggaggggtctggggaccatggtataaagaggaaaccaagaaaaagaaccaagccaaaatcaggctgagaaaaagccaaagaaaagccaaaaaaaaaaaaaaaaactcggncctttaaaactattgggngcntnttcctaaatccccacntgataanatccntg

SEQ ID NO: 2336 - DNA, 825 bp, Homo sapiens
  misc_feature (1)...(825): n = A,T,C or G
agtgaacctttgnactcnnttttttgaggaccatcgattcnattcggacnaggttggaaatgaangcatttttttttntggcntatatccntgacatatggggggnanttttaaaacnacngngcctaaccgtgttntaaaactttggnagtaaatgaacnttngaaatccnttttgataaacctgctgtaaangttttttcccccttggngaangttttctaactttgcntgggtaatggcaattnactaggtgcggnggttctaaagttcgaaggcacgatatgcgtgtccatccttaccaaaggatggggaccgcaaaccgagccgccaccggcactaacctatgaccttctgacctctgaactcttacccatngatgacctgaccatgcctgcctgctgatcaagttaactgggtaatcgcctttgcnttgcctgtcgtcagtggcanccgaagcctgaggcacttgntccgttccgtcttanccttntaacccaaaccaaaaggacaaaagaaaattggttggnccttcnacctcancntttttttttttttttcctggtttggggtggaaaaagtgggttctaaaaaactgcacttggaataagttangtaaaagccaattaagggncccaatttcattcccacaagcacttggatcaatctttttaaataatcccancccttaagccgaaccgggtaagaaagggccctntttttaaanaaagggggaaaaaaagatnggnccttaaactanctcaatggacagaagggcagtttacctgggggaaaaaaacttnttanggaaatcttttttnttttt

SEQ ID NO: 2337 - DNA, 778 bp, Homo sapiens
  misc_feature (1)...(778): n = A,T,C or G
gactnactctttnaactacttgttctttttgcaggatcccatcgattcgaattcggcacgagggatagcccacctcatgttccttttcctgaactctcaacagacactgttatanntgtgatcactaatatgacaaccaccatccagagtctctttccaaatctccaggtttccctgcgctgggtaatcatgactattggccacaggatcaactgcctgtagtcaccagtaaagtgtacaatgcagtagcaaacctctggaaaccatggctagatgaagaagctattagtactttaaggaaaggtggtttttattcacagaaagttacaactaatccaaaccttaggatcatcagtctaaacacaaacttgtactacngcccanatataatgacactgaacaagactgacccagccaaccagtttgaatggctagaaagtacattgaacaactctcagcagaataaggagaaggtgtatatcatagcacatgttccagtggggtatctgccatcttcacagaacatcacagcaatgagagaatactataatgagaaattgatagatattttcaaaaatacagtgatgtcattncaggacaattttatggacacactcacagagacagcattatggttctttccagataaaaaaaggaagtccagtaaattcttttgtttggtggctcctnctgntacaacccagtgnaagagtngttttagaaaaaacagaccaccaatcctgggtattaagactggtttcannaatganccctcggg

SEQ ID NO: 2338 - DNA, 940 bp, Homo sapiens
  misc_feature (1)...(940): n = A,T,C or G
cgggnnnnnnnntnancnttnncgntncncctttttaccttccagggncctttggcccttttaannanggttttttnggaagaaaaanaatggaacntttgggaaaagnaagntccaatggttggntggntttggggcccacccgntttttnattggggccctttccttttccaagnaagngtttcaagaaccaangnaaangttattggaatggaaagccccttttaagggtggtttaccangaaaantggcacctaaaaaatgggggaataaaaggacaaatcttccaaaatctttaangggggancctttccctttactacagaattcaaatgcgagatcttggaggggttacaggggaaacgagggtatcagttacttcagcttcgactgcgcagagagcatcatggattggtatctattgttaccatttattagaagattatgaaatgcacaaagatttagaaaattaggaaccacagcatcctgcaaggtggtatgaaattaggactctcttattcagatcaagtcttcgggagcaggctctatagagaactttggacatcttgacctatgaaaagcagatttgtgataacttgctgtagaagaaaccaaagggggaacttcttgttgccaactattgtcgtttgggaaagaaatgctgcagatgtttataggaggatttgcaaagagaagaaatccttgaaaaacttggggccctattaccaaaaggctttgggaaaaaaagccacttccaagcccnagccttanattntggttttaagnaaccgggcnttaaaaaaaattttattggaangggaaagncccctngggaccttaaaattnttccccaagggggggaacttggggtggcccnaannaaaagggcctggccccgtttnaaaaaccttttttttttaattcttngggggngggngg

SEQ ID NO: 2339 - DNA, 1481 bp, Homo sapiens
  misc_feature (1)...(1481): n = A,T,C or G
gnnnnnnnangtnnanannannannnnnanncnntnannaaggtnannntnnnngaagggggnngnnnaanacgnnngnnnannnangtnngatggnggaganannnnnnnnnnnnnnngngcgggatnnnnnannnnannnnnnnnnnngnggaagtaaaacccctnttnccaanactncnccgggnggncctttnttcanagaaaacnacaccgnggngnccccccncggtggggggnagacganncatcacatacngantntgtagnatntgaataataatatttcntgntcganatttactngctnctgnactnnatgcggggggggggggtgtctttnatatnntacgnatggcgncccncctatnnagttaacntanactangnggnnngancnggncncncgggaacattnancnnnnatgnactgantcannnaaccactgaatcgcgntngtgnaaannnctanngctttatgnacgaatnanggaaaagaatnttncnagcgcganantngcaggcaannnnnantannagntncannggaaaacgtncagnangncgtangnacancnggtatnncgntanangtnntaacntnagncggnntggtanntntagcantnnncgatgtnngcgagtangagtancancnngatgangcgatatntgcatctcgnntatngtgagnatntatgatacagnnagatcngggaagacannaagngcgcgaatgttgnaatatatngactgagtgnagcangcgcgacgnntcgcactacacacgagangngtnnctcgcatttgancttgaatnnacaccgncgacanacgantananatcgnagnntanngacanatactgggtatatctctacgacnganagngtatantgactcntcttaagggagagagtngnacannagtgacgtntacgacangntacgacgagtntgcngagaacagnagagactaanngantacatatatgtngatgtgaagcntagtannggcnatctcgggtcgtatcnnagatgtatcatagnntgacacgncgtcncgagcncacncanancgcgtncngccntnacnnncatnntgntatatnncngnntgtgttacanatagaatntcnnactannnagcgnaatatnannangcnataannncnnntgannacgacncgctncngnannntgntantatgagaagtnaatcangcnntcgntnggaannatcgntgcntntcgggcngnccngntnaanttnnatgtgngnnnnnagnnnntnnnctatnnatntannnantacaganncgacangnngnnaanagagtgtanntnnacnaggatagnaagnnagggnncnnnacgngngaggngcngnagnnaaantgatgatgtaantanacanngcaaanngtnggggantcnnaaacncgntnatancngnacgncnnaggaganagntnagcgn

SEQ ID NO: 2340 - DNA, 740 bp, Homo sapiens
  misc_feature (1)...(740): n = A,T,C or G
agtttananccnctttantcngccgagaataaataatggggacctggttaaatagcttctctacagccaaaanaaataattgtcaaaataancngancanccccccagaaccgggagaaagantaggaacttngtaanctgtgccntgtggacaaaagaacctagttttccagaaacctccaggggaactcaaatcagccaagaaaaataaataatcccaccaaaaagtgggcaaatgacatgaatagacatttctcaaaagaagatatgcaaatggtcgagaaacatatgaaaaaatgttcaacatccctaatcattagagaaatgcaaattaaaaccacagtgagattatcagcttattccgtctagaatggccattattagaaagtcaaaatacaatagatgtttgtgtggatgtggtaatgcttatacactactggtgggaatgtaaattaatacaacctttatggaaaacagtatggagattccttaaagaactaaaagtagatctaccattcaatccagcaatcccctactgggtatctatccaaaggaaaagaagtcattatatgaaaaagacacgtgcccacatatctttattgcagaccaattcacaatttcaaagatatggaaccccctaaatgcccattgccaatgagtgaataaagacaacgtgatgtatatgtatttcncccatgtaatactactcaccctaaaanggatgaagtatgtgtttgcac

SEQ ID NO: 2341 - DNA, 1704 bp, Homo sapiens
  misc_feature (1)...(1704): n = A,T,C or G
nacgnngnaannnaaganngggnnggnnncnngnnaaganaacnnannnnnaanangaacgcancannnnacacangngagagnaancangnncgnnagacgncaaangcgcannncganannaanncgacgnnnnacnnncagnnacagnncacggagacgaacnnnacannncncagnacagannaaacacagcgngcncancanngcnncnnccccccccnnnnccgnggaaacacccccttnnnanncccccncnagagaaaancggggcctcacganncnacggnaacgaangggnccnaagnngggggngnacaaaaatttaccacaggggccaggaacaaccaccggggggggcaaactgnccaaggngcgagaccatactnnggcaagaaagncaagncataccagnacaacngaaaaacagcaccaaggacngactggccaaangnctggagganggacaacnaanangaangnccgaaanaacgaagccnangcngcnnaatgggnnncnaccacgnanncncgaangaaaganggaccannaanagngganngcngagggnacnnacaagnaanncgaannaaggnnnnntgaagngaacnnannacacnaanngnagcnnacncganncacggnacgccacagcagannccagacnnaancnngcggaaggcggagcgaacgacacaaccggcccccannggggggggcncgcnccaanggaggggcacaagnaaaccaaagngggcacgnnanatatncangnncgaanaaacancaanganaaacgcgcccagagcaaaacananncaagacacacaccacncncgggaggagggcaganacngcanaaacagagcgagcgcagaggngacaccaaaaacnaacncagncacncgnggaagcaaanagngnnngacgnacnnnnncngcgacgggatacgngggagagacancancacgnacanncgaccganngcgcgnagacanagacagaccancnggcanacgagacngacgncacggnnaagatnacnnnacgacnngacgcgngacngagagcacgagaaanacggggcgnaagaaacacgnaannngncacacgcgcacananagngananangnaaacgacnnaaagacagganggagaaagnngggacacgnganncanncagaccgacacnngagtgngacacagcgggagaaacacgngactaanacacgaacacgcagcnanacacagagnagacagcgangaagacacagnnacaagcgcgnacgacgacacgnacgnaaagcnaacngacacgcgnacgangangcncngacaccacgagaacgacgancgcananacacnngngaaagacgcncncgngagacanacgcacgntgnacggaaagcgananancgagacacgangagacnacncgcacacaacacnnanangcgnggacagancacgcacaacagccgacacncgcgnnncgcggcncaccnnacncgcggacnncaancncgncaacgnncncncnngcgcngagacacnncgcacncagagacagaacgngnnnacacngacaggnganncnacacacaagcnancncgcgcgnagacggnncganagacngacgagaanncacncacaaacgcngnnaacgnnnggnaacancnngccgnancncacaanccg

SEQ ID NO: 2342 - DNA, 815 bp, Homo sapiens
  misc_feature (1)...(815): n = A,T,C or G
gatctacatctcctnttactcagntcttgggcattggccttgtnagngttgcgaacctcttagnagggaatcccccantctgngcacaccgcaagccaatctnnattnaaaagtacgntanatcccttatagngtagnganttttttntangtaaanacnaaaattttcnccctcgnncccgctnaaantnaccggggggggggggccgctttttttttttnnaactatagcaaaaaaaaaataatctctctcgcagcatgntataacccnaaaaaatttnaatatactntccttatgggctcncttaactaaatnncactttttttcgnntaaantttcngtcnnnactaatatnttnaaattnagggcctcaaaatntaatncttatatttaccnaacntngttccncaaanctnactannaaatntntatcctnnctntntnnnggcataaaacaccanacngngtgatgggttancgcagngcgaccnnttnanttgccagtcctactcccnttncttnntttatncttnntantcncanccatnnnattatactaannttnaaaggattcacttttttccntaatcncattnntaaaccttacgattntnctaanttgtttanaggcttcatcttgacannnatataanggctgngtactttttaatatagacnactgacanctnacccatncgnnntntgattatatgatnccaatctgcctttttaaaaatactattanaannttaccaattnnaanattangntnannantcgannttattntntancntttanaacattnatacnn

SEQ ID NO: 2343 - DNA, 1440 bp, Homo sapiens
  misc_feature (1)...(1440): n = A,T,C or G
aacacncacgactnttngtcaaaancgngnaaatannntggcatcnnattctcaaancccgaanatancagcgnnntctnnnnaacatcagcgcgngacacngcanattgnagatattnngagtgatactagtgaatnnagncgnaaccggnngataantganagcntaannanacnagngacatcnngnntncnncncngngtttgnaaaaccccccgttacgcggcacatacacctnctgatnngnngctatnnngtngagactcatgaagatcagccgtncaacnctananatcnnctcgactactcccacagcggggagagngggngganatctaatcanganacaattnataatctattaactaaatnancnctgganaccnnncanaggnggggggggntgngaatnctnggagacnanaaactnaacnnantntncancctgnttnatnactnngannganannnacgnnanganngnnagccnanggagnatgatatnaacgcgatnngggatacnnngaagncngtggnaagtananngancgnatagnannagancnanaatnatcggtanngaggngngnnggacatnccgatatntngancgccntcnattgantnnannnantntnnncataaatntnananttnggntgagnatananncaangttgnaatacnnacnnnaanagtgnatnanntgancngancnnntncatactancttgnncnnnnaacctncttgangcnnntcgcncgnaatcntantgcganannacntnnnnggtnatgnangntnnngaganttntanccannnntnngnnatnntancncgnnttcncnatncgantnnncagngannntnaannnnggnatcgnctatcntnacgctgcnnancaagnnaangngcgtntctanatcgnnaggnnctancncnncancntgcancacncattgttcatagcagccanntcncannntacanagtnngtcncgaagancctnancgaanctgananantangcangcangnganagcacanngnagancgacatgttnncgaggtgtcgnatncncttnagannagnngacanncncngnactcncgcgcatancgcgcntananncgagctgctcncggtgcnacntatganannnatctgntananaacaaanangcgngtgaactncctatcatcagggnncnctctannnattgatacgtancttnatagnnctaggnatnatcnggcangacggctgntgggngnnanncacgttatacacnancngcnnnagannannactangtnanncgggagnaganatgnangctcncactactncncanacganngcntctgtncanaaganantgnncanacaaanangtataactgtgngncatgcgncaannagatacaccgcc

SEQ ID NO: 2344 - DNA, 919 bp, Homo sapiens
  misc_feature (1)...(919): n = A,T,C or G
gatannnnctntctcaagcntgcatgcctgcaggtcgactctatagganccccgngngccganctcctntaatatcntncanatganttttttacaacnactgnctcgcccttctacggggggnnttttttgactaaaaanatncntccntttaacntanttaacctncntgnagataacnnccccnttnanccngctggatntaataactaantaacncccncaccngatcgnccttccaaacattntcngctncnatgantatngaanngcctcnccctncacnnaccaantcacncccgggnnggntntggntggttnacnacacaannntnatcanattcantatgncannnnatctaanctnnncgttcctttnnctttnctaccctntantttactnagacnanngtacgccctgnntctnngtcnntcaaancntttnaaantcnnanagctnctttttaagggntaccangatttaatgncntttaanngggaacccttcanacccacaaaaaanaacttttnnnntaaggntcggattggttcnnantgttnnatgnggtctattcngtccttgaaanannaatgggatttctnccnnccnctntctggancgggattntaagnnccacnttncnatntaaaattangncggnnncttctttgncccccaaaacanntganccnantaaaccccagctcctttcnggnnngagnttaatttatttattgtaataaaanaaagggaatttgcntcacnanttccnggacntaattgaantaaaaaaatcagctttntanaaaacaaannntaacncnaaatttccnacccaaantanttanctncntaaccannttcntngcnagcnnntanttcctcnttaaanaactntggggggatttgnaacncccc

SEQ ID NO: 2345 - DNA, 724 bp, Homo sapiens
  misc_feature (1)...(724): n = A,T,C or G
ngttacnnccntcgctaattcactcttcagtagcttctaaaaaataagcatcatcaatgccattatcccagacagcatcagcagatgcacctgttgacagcctgctaggtgatgggtttatgaggattctgggtttcattgctcctagtttcatctgcttcatctgttgtaaactcttcttcctttatttcagtggtgaagggatagagagtgggataggaaaatatttactcaggatatgtgatttaaccttatactctatgttgaagtaaggtattaagtgacagatactaaagtgaatatgcaggaggaatgctgtctccgatatctcaccgtgggaatgagtgcactgattcaaacgttgctgcactgaagctcagacacacttgaaactccaaatttgaaattacctacagttctgtgcacatacttttcaatactccccgacggaagagcaagggtggatttaattttttaacaagtggacagtccagctgaagacaaatcagaagataaatttgctatcttgacaatggacttagtacccatgctttaaattttaaagtatttagcaaatcgtaaacatggattgaaaaaagattaaaaacagttgccaaaaaaaaaaaaaactcgncctttaaaactnttgggnggcgttttnccntaaatccnaacttganaanaactttgttgggttnggacaancncaccntaaaannnnnnn

SEQ ID NO: 2346 - DNA, 1085 bp, Homo sapiens
  misc_feature (1)...(1085): n = A,T,C or G
ncngacncttncaactccngngnntttaangaacccncggggcccccnncggggnggtccctaatncttaccaacnacannttncctcgtcacncnaanccctcgacggnngggnntnttttttnnnaaacccttaaaaccctccnaatnaagacctcnnancgntnnccgnngatnnatgaatatccnatnaccncntgttnactncccntannnntnttaccnagangnncngnttcgcnacccngggcacnctccgcannnatngtccncgnngncgttcgtataataanntncntcgctacggggttgnggancatacggatctcncnacaatanacctctgatanataanncggaaggcctcggncaatnntctncgtccgtacctntcgactcttcananatncngncntactncatcnntgtgnncncgcacgcntccccatcgntgggcgnntgngcgtntactngtgaanantcatntctgcnnacgaacntncncatncantatttgagggcaacacnntccnctacaaantnncncccatccngcgcagggnggtctacncanacatnnnnntatnntccctnntcgccnnnaacncaggnnaagnnctcnngatccaccccncgnaanantnaaatactnctccnntgantnacctatnanagngngttnngcccnncnaangtcntcntntccaccntcttntangntnnnaatngtaccnnctnncanngaggcgancnnnnnncnanaaganccantaatcaatncnctgtcccatngnnntnaanttcntctaacncnaacanantgaanatcnatcncccgtcncngggtanaanananganataacnncnnncntccgcgacnatangttnngnnnntgaccccctactataacncanacnnacnncngnnngnnnngtncgcntnatggacnacgacctatcaaanncccnanatacgngncnattcccnatncnntctctgaatattgnngncnngcaanngacncccncncnangtgncnnntgnncnnganntncatccnggntccanagcaantnnnngncg

SEQ ID NO: 2347 - DNA, 749 bp, Homo sapiens
  misc_feature (1)...(749): n = A,T,C or G
agntttgaaccccttaccagtacnccgcnaagannatttcaacnnnngtgnttnanncctatgagannntgctgnacctactgancctangactgcaccnattcnanctcnatnnagnatgagatgncnnannggacatattctcnanngnacnngctanatcttntatanaccntggaggctngtganaaantcgcanannctcaacctgaatnngccatnnnngacnttganacattggnaacgctagaccctaagaanatactgcaatgagngctgtgcntttgaacnctatgactannagcaagccngggangttntgnctcagntnanannctctntanatattgaagagaanntcatgtttctgaagactccctncaatgtggatangataacnnaatancaanntgaagnanntgctgngcgnancggcnnncacctntnannccntnactcntngaagcccnngtnnntnnatgncnaagtcctgactncatnacnanttcggtnnanataatgnngccncatcgntgcnnannatncnncatgaanccgngcatnngggcncttnccngtantcncngctncctggtaggccnaggcangngaatcagcttaaaccccgtnangggnangttgctgnnggcctagatnacncaactgggnttncagcntngggccaccagaggggagacttaattctttgnaagngtggntncnatgaanacnntnannattnttggtnt

SEQ ID NO: 2348 - DNA, 1678 bp, Homo sapiens
  misc_feature (1)...(1678): n = A,T,C or G
acntnacnnaagnatcgnnnnncaannnncncaanntcgaagcnancacncancnannaacnaggggnggatactnannnnaacncnaanacgctngacacggaangnnnnnnnnnnnacccnnnnanantnnntntncgangcagcgaanacancnatannggtctgatatacnantacacacagcnncngccanccncacananctnatntacagctacgcgcccccctntanngaattatcaatatacgcgangtgancgtacgnanacanctnacacacccnntttttttctncaancangncgnacccantnaannnacgcggcggnnggaggggngtanatattattcnnanacatanaaatncgcntaccnnntancaccnancncnataaacacncaanaannagaccnaaatgaaatgacanttanccgaaantanccacnacacnncgnatgcaactnncntcacangnagaaanancaatnatantatcancaacactccntacnaccnnctcnnngcanatncgaanccatantnaancataanntntgactacnntnnannggttaacnacgtntagacaaannagangtctcnnaacacnaanatattctnncgtnncaantanncacccctnaacatctacangatataanannccacgacaatacnctntcatancatntncncagcacacgannganancnatgactnncgatntannttnnnnannncataaagacgcntacacatnnntnaanccnacacantntcacnnanaaccgacagatcaaannnaatgcagnatccgntcnctcaancnacgaacgacaatgctactacatacgcngagcgaccnagaaacnactaangatcnaantcggacacncacggncgtnntnnntgatagacaaaccgacacaagacgacnaacgtaaccacgancatacnnccaacacanncgnannatanncgtatctaaagacactgaatcnatncgccaatanganagcgctctgtncgagatacncactaagtaanccatacnncggagnaagacagggaaagatcgncacgggaaagncgngnatactgaaagnnncnnnactacacncgnaacgtgtnaaangtaacnacgcnatcgacctcacacgaccgncagcctntnnacacanagagaaagcgcacgcancacgngaaangacgngttcgnccaacanatnccncaaacganctgtnaaacgcanggcacaagtnccggnanatntnncgncacattacatcggntaatccncacgcnactatnaaaactnncnctcncacacnnatgngagtcaanccgcnaatancgcggcgaacaaatggcctataacannctacaanatacgcagctacatnactacgcacgtcaagcgtccgatnanaccgacanatnnntgatacacnacaccacacatnnntactnncgatnccntncagnngacangacncnngtaantagnncntncctcgcnatntntcactnnancgnagnnacnacnnanaanntgcatagacncantcaaagaggatggacacntnncnnangatanncnanagctacatcnatannnatnnntngagcnctngatatncaanctncnactcacaaacacatcnagtgncgn

SEQ ID NO: 2349 - DNA, 1424 bp, Homo sapiens
  misc_feature (1)...(1424): n = A,T,C or G
gtactcgtnaanaaaccccccctnttttacccaaaaaccctttacctctnggnnttncttttttttttgtccnaatggcaaatccnccccatttcggggagttcccnccccccncnatngggtggagcggananaanntnacccnaccaantcacnanaanaggcgctctnananctcncnatantacntatatatnatcaannnccacnataccttaatactatcgacanancncactatnngaggggggggggggtatttttttttatgcannacataaaaanntgnntatcactacnctanacncttantcatacacgacatctnaatataactntancataatnaanncncataaccaatnntaanatncattttcgnngatnnttttcaaacnnaaataaatntanttanctcttannattaaanaaaganaatnanttcactcactncntgantanataaantnnntactncaanaataantntcatacaattanananntacatnanttnnntatcncanacanacnnnntantnnantatnncattatacactacnaaganatattacatntanctacancatantctgntntattctcatntnatanaaatnnnatnacnaccntanataatnatgcatannntntataacntnatatnttnctnnatacntatatacattatatacntanagatataatcntntnacanacnanatcatcatnantccgnattnaatntacacgtacacaaatcatgntacncnctacnataaancntcgntatntacataaaaacacaaatgannacacactaagtnaatcaaanattcatactcgtatntctcatgtnantacacntnctacngagactgnantacacatatacactatcncntgtanaatnngtgaaatatnataaanacgaccngattgccgagtcatnngataaatcanacactgtcaantctcncnananatgcannactactatcaacataatannataanatananccctctatatcattatncctnatatatacnctaatacattnataatgannaatanctatnacaatacattatgacaataatcaanatctacactntaacnatatcatnatnatatntatanagcacttatataatannactantntnaacanatatntctagacatnacaaactntnatnacacgatanataatntattnntanaaaatanatatnncccntgctatnatnananggntaatncttaactactcntaagannatatttatcanatactaacnnnannaatntccacnngnatctatantatncngtactaaaaaatnnatntaaannacntntnnntcatnaaagtanacaattataatacanaaacctcntaaatanttntcanaaang

SEQ ID NO: 2350 - DNA, 723 bp, Homo sapiens
  misc_feature (1)...(723): n = A,T,C or G
tanacnntccaaatgtgggaactgncnaancnaannngancaacntcaacggngtncntaacntaatcntaatngcntcccgagacatcgcggntggggaggagctcctgtatgactatggggaccgcagcanggcttccnttgaagcccacccggggctgaagcattaaccggtgggccccgtgccctccccgccccactttcccttcttcaaaggacaaagtgccctcaaagggaattgaattttttttttacacacttaatcttagcggattacttcagatgtttttaaaaagtatattaagatgccttttcactgtagtatttaaatatctgttacaggtttccaaggtggacttgaacagatggccttatattaccaaaacttttatattctagttgtttttgtactttttttgcatacaagccgaacgtttgtgcttcccgtgcatgcagtcaaagactcagcacaggttttagaggaaatagtcaaacatgaactaggaagccaggtgagtctcctttctccagtggaagagccgggaccttcccctgcacccccgacatccagggacggggtgtgaggaaaacnctgcctccaatggcctggacgggatgtttccaagctcttgttcccctaacgtctcaacangcgctcactgaagtgtatgaatattttttaaaaanggttttgcagtaagctaatctttccctntgcttttc

SEQ ID NO: 2351 - DNA, 724 bp, Homo sapiens
  misc_feature (1)...(724): n = A,T,C or G
tganncnntcgantcggcacgagcttcatataatgannctatnangncnaaggnaaattanncaaangttaagncnntgngtccaaggncnttcanntnaaaaanggancngggattngaacctaaagtanccataaaatccttccttttctacaccaccatggtacctcctagatgaagctgaattttgcctctaagctactagtcctcacaatttagtttacaagtcatctggggcataaaaaccagacacctagaccttatgtagagattgctacagcacaggaacaggtgtcttagcaagcatgacgtacaactaagatgtgggttaccatggaacccaatttgaaagtaatagttttacattctaaggtattccaactattttttttccttaagtttcacatcttgatagaccctctacggaatctcttctcctaaagcttgtttttacagtgatcttgccattcctggtaccatacacattatcatctggtctgtggttcacttttttttttaaatcattgaaccctccttcacctggctttttaaagccaaaagcttttctggagccccaagatcaccccactatgtacttcctcatatttaggcagtttacaaaacattcacatttggtatctctgactcttaaaacatncctgngtagaangcacaacagctattattttcattttggaggngaaaaanaccagggtacactgct

SEQ ID NO: 2352 - DNA, 761 bp, Homo sapiens
  misc_feature (1)...(761): n = A,T,C or G
gntattcgttcagctcttgttctttttgcaggatcccatcgattcgaattcggcacgagagatagtctctgaatttagaactgggacgaaagtgtncataataggctnttataaaatttttagaattggatttctaaacttggggtcagtgaatctagcaggcttaagcagtgttctcaggtttttctggcacagacaaggaatataagaggaggagagaaaaggagagacagtagtggggagggaatagaatgagagaagatagaaaatatggaattaatagagaaaggatacatgaagtattacaagattttcttggaaaaattggcatttcagtgatggatcaaagatgtctaatgaggcaaaatactactattacttaaatatttaatgttttaaagatttgaggataaaaggatatagatctgatggccgttcatactaattgctgtantgttgatgttggagagaggggtaatgtatcaagacagagcagacagaccctttacaatgagagcagaagatatgttgtttactgattctactttcccacaaaatgctaatgcttttataagtccctcctccttattttctagattaactccttgttcttnctctaaacagaggattatngcagacaggccaaaaaaaagcctctagaactatagtgagtccgttttccgtanatccagacatgataagatnctttgatgagtttggacaaacccncactttgaatgccgtggaaaaaatctttnttt

SEQ ID NO: 2353 - DNA, 732 bp, Homo sapiens
  misc_feature (1)...(732): n = A,T,C or G
ttanncnntcgantcngccgaggtcttttnnacnngtaccagcnnagnatntttttttttntganatnatttttgaatgcttttgtgtggaaccacatgcntcataatagatncaaatccatgaaagtataacagttaaatactagatcttactttttcaggttttgatttctcatctaaactttccaatgctttatcagtgaagcaaactaactcacattgactagcctgctctcctttagcaaacccttcaaataaatgcctcatttgctcctcaccactatcattttagattggccagacagttgttacttaccttttaagaatgaggagacaggtagccgggtgcggtggctcacacctgtaatcccaacactttgggaggctgaggcgggtggatcacgaggtcaggagatcaagaccatcctggctaacacggtgaaaccccgtctgtactaaaaatacaaaaaattagtcaggtgtgttggtgggcacctgtagtcccagctacttgggaggctgaggcaggagaatggcatgaacccgggaggcggagctggcagtgagctgagaccacaccactgcactccacctgggtgacagagtgagattccgtctcaaaaaaaaaaaaaaaaaaaaaacntcggccctttaaaaatttttggggggnngttttcccggnaaaccccaacttntaaaaaaaaccttttgtggagnttgggcaaaaccnnt

SEQ ID NO: 2354 - DNA, 757 bp, Homo sapiens
  misc_feature (1)...(757): n = A,T,C or G
gntatncgttcagctcttgttctttttgcaggatcccatcgattcgaattcggcacgagaaaaatatgggctgggattacaggcgtgagccaccacacccagcctttcttttagtgctttaaatatattggccctctgccttctggcctccaagtttctggatgaaaaatctgcttgtcattttattgaggatcccttgtatgtgacaagtttcttccctcttgctactttcaggattctaactttgcatttcaaaagttagactataatgtgtctcagtgtgggtctctttgagttcattttacttggagttacttgagctgcttggatgtttatatgcatgtctttcatcaaatttgggaagttttcagccattattcttcaaacatagtcataagctgcataatgacattttggtcatcaatgaactgcatatatgatggtggcctcaaagattataatactgtatttttactgnactttttatgtttatatgtacttagatcacaaatacttaccattgtgttataattgcctaagtattaaatacagtaacatgctgtacatatttgtagccttggagcaataagttatataccatatagtttaggtatacagtagctataccatgtaggcttggtataagtactctctacgatgttcacacaatgttgaaatcacatganggatgtattctcanaacataattttggttggtaangggatgcatgactgnattctctctgcccctttctnt

SEQ ID NO: 2355 - DNA, 828 bp, Homo sapiens
  misc_feature (1)...(828): n = A,T,C or G
tattatncgttcaactacttgttctttttgcangatccctcgattcnaattcggcacganggncnacnnntttntacacttngaaccccacttttntccctttgcccntttgcngtgtcnctttttgccggaacccccctttgttgcccgtttgaaaggncgttnttgttgttganacgccggttgcccanccccaaaaaaggagggtntttaaattgnanttcntnttttntgaggnntccaaggcntttggncggaaagtggntggntgccttttgtnattgaggacntcntggcntccaaggggagcggcctggcaccntctgcctgtgaactggaggcaacntggggggccgggccaccagtccacantggcaatgggtggtcctggcccggctgcaatggtcgtccaccgaagttggcctacttntcgcttaagcgccttgcccttgataanggggattgtgctctttgggggatgaaganggcaacgttgttggcttttacgacgtcagccaacatnctgaagcagcccaccccttgcttgcccggcagcccttgcaggcccccacacagatcctgaagtggccccaacccctgggcccttggccaagtggtgaaccaaaaaccatngtngaacacaagtnggtnggncaatgccttcctttaancttaaccttaaccggcccttgacnggaacttccnaacattcgtnaacccatttttggggggaagggatttttaaccctttaaanacccantttggnaaaaagggnaccaagggggacccccaagctttaactttaacntttantttcaanccntttt

SEQ ID NO: 2356 - DNA, 1197 bp, Homo sapiens
  misc_feature (1)...(1197): n = A,T,C or G
cgtcncncanctnngtnatnantnatntnngtganttntntnttnttcnttgnnacntnntgttgnatgntntgcgtgtnncntcatnagattttcnattangtgnnnngatctttgtgnnangtgattantnnnnnnnnnntatgngaaacccccgtntcgaantcggcacgnncantgntcntanntgtngnatgctgtctccnacntgtnnggtagnatgttgngttggggggngggntcccatacatcatannnttcntaaaattgngangntntgatggagnggttttttttncnagcnntttnaaagctnagtngnttgttnctctnntgccctgnnatagnngnnttnnnggntgtgtccnncntnggtnnnagnntnttnntntnnnnntgntannnnnnatgtanctagntcataatttgtntatnggacattnncctacttatatttaatggtgnttnnngtcnantcggattntntatntnnttctattntcantttnntannnatntccnnggacgnatccatntgtatattttcncntatgnnngnncccnnatggggctttgtcacatngactnttgtactnnaccnattgcccctataaanntttttttccncatngntttgaanggngatangacaaaaaanntggatctnctntgtgcttnatntnttgannnttnatatntcgccgnatnttntntnnanntanntnnnttnaatnntgcatanctntanttnngatgantatngtgntatgnnttgntntntattatctattcncantntttacagntctnnatntnnntntnctacnnttttttnatncntgtaatgtangnatnagtntngtctgtatnnttnntcnnattncnnntnntccctntatatntatanantnactttanccnnnnttntatngntcgnttntctntcatngtcttctattcnctttntancnnntatttnttttgcntttnanatnntaancnatnttngcnaannanaanttgntgnntnctctgatntatatgtcntcnagctatcttnnatatcgnattatgataatgtcnttacttanntanattcgncntattattnnctnacgtntgantnntntagtgngattgacnttnttttttctntnnnttancnttggtanntagtgnnnttnnatcatttnttng

SEQ ID NO: 2357 - DNA, 921 bp, Homo sapiens
  misc_feature (1)...(921): n = A,T,C or G
aagnnaacnttnaacgagcaggcctccacggccanncagctgctcacactggacaccacctctatcctcctgcgcctntgccctgtntttntnctgcccggaacgcccgnctgctggcnnngaaggcgagggcggnangccgctgaatgggactttncggnttggaaccaacccccaaaaaaaggangggnnttgtnnaaaanaggaaaattcannattntnntgnagggcctcanaaggnntnatggnaannggagnanatngnaaatgganatagcaattntggnnaaatggagggacaatgngganggncntccaaagggggaaggcgggaccnngggcncnaattctgccntntgggaagnttggaaangnaaaaanntnngggggggggggnccgggggcnaaatccaggtnnaaaaaatnggannagtggnatggnttcctngganactgggcttgngaaaanggtaangtccaatccnnangngnggcctttatttattttgcttaaaataacnctnatccngnatntaaggggtaatttggnnatacngntnnggggaantnanncanggtnganatnatntggnttaattanataannaacttanaaaaaaaattatanaaaanaangaaatcccatatnatnanattaaacaaaataanannnanacntttgaactantaaacnataatgaantncctcaactaaaatntngannaanttgaatttatgaatcannanttcaaatatanattataattnattaattntatatanannattantannatttnantatanntnnntacntaanttataatctcttnaatttanttannnanagaaaatantaanannncatnaaatnttnattaattttnaatnnattnnctgntatantanganctntatnc

SEQ ID NO: 2358 - DNA, 870 bp, Homo sapiens
  misc_feature (1)...(870): n = A,T,C or G
annnctcttgactcctgtctttgnggatccctcgttcgaattcngcacgagggantatcctggtgnaggggccttttttncnggncttgggggccttgggatcccgggggttncagnntnagggnccttnagtccttcanacccngcaaatattttgcgcnnangaagnanggtnngtnngtanctaagttaaacttagaancagaccctcattcagttttantaatgtattttngcaanctactgtaaatagcaaatcaatgccantgttaaacaaagaggaaacgttgtgtggncttggttctctngcaccggtatttcanggaacatctgcttgccatccccacagctctttaaaacctggctattatggngtgccctttcattcntaccatttctaatcatacctggcagggaaaaaaacattgggattcagccttaagactggagggaaaaaccttctcccatttantggttggntaaggaaaattantaggatggttttggaggaagaccacctttttttggttaaaacccnagaatatttggaacctcccagccaacctatttggggggttaataattttttaaggttcaattggntcctncaattttaaatgcctaaaatattcccttttataattngcctttnaataaattttcccttttttttccttttttttttttttttaagaccngggggtcctcgcctcttggttggcccaggccttgggaggggcaannggcnnccnanccttggcttttctggcaancctttngcctncccaggntcaagccgaattcttnctggctttcaanccttnccgaggtagctngggactacaggcgccatgccccncnatgccccan

SEQ ID NO: 2359 - DNA, 722 bp, Homo sapiens
  misc_feature (1)...(722): n = A,T,C or G
ntttgaccncgtatggcgccgagaatagccnaattncntagannaagaancaaaanggcaatctgagtagaagaaataaggagaaaggaggagaggtgtgaaaaaaagtcctttttctgagaacaagcattcaaacagataaaacacaggtttcataaagaaaagttaaatgtcccactactatgagtcaaaatggtgcatttgctttttcctgggttttgatttattgccctctgtttgtaccccacattcgcatccttggcacagactgtcatatgtcacacattcagcctcctacacttccaccccacaatctctttaccttccttcttaatgttcacctcatttatctttactcagctaaagtcatagcactagacagtgttcccacaaccgtcttcaaactcatctgtatttcataatctctcctctagttcaaaccagcacaggtcagctgaaactctgaattctacaaataaatatttagaggaagctaacttcatcagacactcccctatgctctcagttcaaacgaaagtttctgttacatttcacctacctacagccttacctcactcagctagcattagactactcagcaatgagttccaacattgccttgctaaaaagcaaggnggctcacaaacaagacttcagcaaagatgcattnaaatgtgaagtctgcatttggtcaaggctaccttanatggagtaatcatggg

SEQ ID NO: 2360 - DNA, 1335 bp, Homo sapiens
  misc_feature (1)...(1335): n = A,T,C or G
naggcnagcccncnctatgagaccccagcaccatggacaagggaaggacacgcccattttnncnggcncaacacgacaaaacgggggggntnaaaanaacngtncccacntntctnnaaacccccagcacggnnngnnaccnaacgaaaaagnncnnaaggcantaanccnggcnggggcanaacggcncgcaacncncccccnactggctnaaagnggancaccctaaaccnngngnaaacgancgggngaaatcggcgcanncaccaaacccaangngtgnnccgngngnggncgtaaanngtananaanacannccganaaacggngcnaacctaaanngacangngcgnntggcncaccccaancnacccnagcaacccacanaanacggggcnancgcngnnaggnagaccacnctncnncntcggaacacngngcaggacccncgcgcncgannngcataggnggcacacacactacnaaaggnacncnangannggagcatcanagattacgctcgganaccnacncaccccgcggnataaanaccgnnanngaaaagcaagcgcgccacnagagnanggacactagataanaccccntcgcanacccnnnatcggaccnnnacnngncacngnggagcacangtganncccctaagangtgaangaacnctgggggngcaaaaanacaccgcgacacncaatatnggggctatctacgaaacccancggatacagcagtncaanancnagcnngaaacacacgnnnnggcnctgggaaancagcacaatcngcaaggcacnnacccgaacncnncgatatgcacnnncaaccnctctaccttanangcgccaaacgagacnanctannaaagnacaccgtgaacagggaaacaacatctgnggncantgacacactnatcgcacacaannacgtncaaggcatangnagaatncacgnagnnaanacgagnataacagngggnnaatnngacgggatncaaaaaaannggcnncgagcagtacatcaaggcacanaacntgagcaantcncgcaacacanaaggacacgcgnnaagnanatccaaatanntancggggacncccncacgtaanananagtcncnagaacgaaactntcattgngagaccnaancagntcacagnangantcttncgaccaaccnnntgnaaacacgcaccggggaaaannaanangccancncaaccaaancaagcggganacnnaaagnggcgcncnacccngatgnnacnncannaaggcaagntcacagncggaanganctnnnnanccaactnnnagccgcnc

SEQ ID NO: 2361 - DNA, 1082 bp, Homo sapiens
  misc_feature (1)...(1082): n = A,T,C or G
tnnnnnnnnnnnnnnnnatnnnnnnnnnnnnnnnnnannnnnnnnnnnannnnnnnnannnnnnnnnnnntnnannnnnannnnnnnntnnnannntanntnnnnnnnntcnnnnnnnannnnnnnnnnnnannnantnnnnnnnnnnnnnnnnnannnnnnnngttttgaatcctttcnnaaacaccnncannnnnnnntananatnnannnnancccnccccactgangnnnaacccatnanngnnntgggactgggctgantntacagattgatgaggacattcaactaggatggctatgatatctgggagaccataagtganggtcttcgctcaccccgagtagatatttngcattacanttgaccccatatacaccaaggcaaaaaatggctcctgggcagcangctatggggatctggaacactgnaatccaatcagncattcaagagggcagcactggaaaanttgcttacaagggaaattcttgggttnccagcgaacttggggacccccccttnaggcnttntntaagcaaacccngggataanatcgntntaatggggctccaaatncaaccnggnattgcccntttgggcctaacnctgngcnnaaaaanggngntnnntggganttttaaatacaatgnanttcctcnnccccaanncatgnnnangggcnannnancnngaccttactcngcgaagcccnnnnantcnnttcananatgnanatnannnnacantnnctnnannnatggcantntntanagaanaaagtatntannncgttcttgcnacatcnncgganattnntttatcncntntntnaannaccccccaagaaagntnacccccttagggcttaantgggangggggttctggggggnccnntggntttacaagngggnaaccccatnaaaannggaaggcccaacngcaaanattnangctcttgnngcaaaaaccaancctnnaantncctcanaanacataannnnnngctgccgggntngnnttctntnnatcctcctntnttttnnaannatcttctctttcnattnnnnnnnctcaaatcc

SEQ ID NO: 2362 - DNA, 1687 bp, Homo sapiens
  misc_feature (1)...(1687): n = A,T,C or G
taannccccaannacnannccaantcnnnnctgatntncgaancnnangnnttttatcttacanttcaaanaanggggnnacnnnacataanctngacnttaannncgaantcgnccngaggncacancnnnncgcgcanacctnntatgcnntggnatcacactgacnaaacatactnctcacntncctncnacactctccatntcncnccactatanctctctnatctatactanatntcatncncgcgntcagacatnttnnnnnntnctnanncnctctnaactcaataanacncnctacncnctcactcatntcattaagtnngntaccnactatacactntntaccttctcncnaatacncnacntcnacatatattcngatntctacgnctatntccnntatctcnncaacnanactntcatcntcttannncntnccatctanntnncnncncgtnncatcnngnnnactannacaaacgtcacantcatnattnatnncatttcgcatgacancnantctcncctttnttcacgnacancancngtccanctacncncntacncaactaatattnnctcgctcaacanntcntaatnnatnnnntcanttnntntatcnttnnatnatnnnctaaanatgnattncttcnnagctnntncgcncgactntgncaatccancntanatnacgntnacnatcntctnnacaatgntcntctttatcncatncncncntnntnncaccnctntctcgtcatactntncccatanaatgatatatcntccanacaatntacgtgtnatcaactacncnttgnaganatgcagtataccntcgantaanatcnctcagtctcnacctgacatntnactntcacttnaattctcnacanctantnncantnaatnatacatcttactnactntnccgctaacgctctacncgngacattgtantcnctatnatnatntcncntactnactcngcatagacctcacntgtanagantctncananatgtcnngctnngtcntntgtgtaaccaanactattgctnaaactatcatntccnctctccactcactctatcncactatantccntanccanancntttnactctntntatatcatatnantacacncgcgcancgtctcgnntcttntntnntnctncanccctntcntnctnatctcttctcannnatnacataccgccatcatagcttcncactatnctncatatnttntacacgataacgcatnatctgcaacntnnncactantnantnnctnncagtnactcnncttgantcnntcacannnngacnnancatatcnttcccgannatnntctntgcntacnnnnnnattcanncttcnacntntnncactatntaccncctggacaactnnatactacnncgcnatagctnatancactcnnnctacnnatctcacntactccactgnnnnttacnaacattcnnntcatgatatatganatgccnntnctacgnatnnantannncnnctntntntcatatcncgnnaannacgcgtagcnatcttactccangtcnattncctcccaacatntntaactnatatnanctctngnctcactacgnacncnatancctcaatcnccataacacncntatccancatatccgn

SEQ ID NO: 2363 - DNA, 780 bp, Homo sapiens
  misc_feature (1)...(780): n = A,T,C or G
nnctaaccttgnaancccgncntttgcagacccaanaggaccccgggtaccgancncgcatncgnccnnaagggagttttttnnnaatccactggcccggngntccacagcgggngggantgggaaaacggtggcgctnccggcctngaccgncgggngggganangancnnacacacnnnntngcggacactcgaangggnnnaaannnggcnncgttggaaggaagggaaaaganngnatnnccaataggangaactggtcaangagatatcannggaaaaaaggancgaaatctnacntcttncncacaacatanggcnagnnatatncagacgattatagacctaaatgtgaaagcaagacacatcgtnncagatgataatataggagatgnctcatgactntgcattagtggaaatgtnatnaacctacacccagatgcctgtgctgatactgacatgactataatagagngggaattngccagnctgcactcaatgcctgctcatccaaccatctttaataaggcatcaccatgtgcctaccctnttaaggagcaactagaaccactaagaccaaaagagaatcctcactccttcccttnctncgntcgctcaacctcttttggntcaggtatgnggnaacttggaagcttaatntggaactactgggatatctggactngggagcccncaagatacccgaanctggggattgggncttacntggaaaacacagcatggggaaataaacaattaaaacctnaaanaaaaaccaa

SEQ ID NO: 2364 - DNA, 730 bp, Homo sapiens
  misc_feature (1)...(730): n = A,T,C or G
ngttttgacncctnannantcggcacgacttaaagatgcataacanagtcaggggattcattctatatgatatccaatgagtatggcattggcataaggctagacaaacagggcaggacagagggagtgaatgaacagacacacatatatttggacacttgaatgtggataaaagaggcaatgtaggaaggaagggaaaagatagtcttttcaatagaaggaactggatcaaagagatattcaatggaaaaaaagaacgaaattttacctcttcctcacaacataagtaagttaattattacagacgaattatagacctaaatgtgaaaggcaagacaacatcgtttccagatgataatataggagatgtcctcatgactttgcattagtggaaatgttataaacctacacccagatgcctgtgctgatactgacatgactttaatagtgtgggaatttgcccagtctgcactcaatgcctgtctcatccaaccatctttaataagtcatcaccatgtgcctaccctttaaggagcaactagaaccactaagaccaaaagagaatcctcactcctcccctccttcgctcgctcaacctcttttgttcagtatgtgtaacttgaagctaatttgtactactggatatctgactggagccacagatacagaatctgtattggtcttactgaaacacagcatggaattaacattaaacttaaataaaacaaac

SEQ ID NO: 2365 - DNA, 728 bp, Homo sapiens
  misc_feature (1)...(728): n = A,T,C or G
ngttgaccncnntcgattcggcacgaggatagcccacctcatgttcctgtacctgaactctcaacagacactgttataaatgtgatcactaatatgacaaccaccatccagagtctctttccaaatctccaggttttccctgcgctgggtaatcatgactattggccacaggatcaactgcctgtagtcaccagtaaagtgtacaatgcagtagcaaacctctggaaaccatggctagatgaagaagctattagtactttaaggaaaggtggtttttattcacagaaagttacaactaatccaaaccttaggatcatcagtctaaacacaaacttgtactacggcccaaatataatgacactgaacaagactgacccagccaaccagtttgaatggctagaaagtacattgaacaactctcagcagaataaggagaaggtgtatatcatagcacatgttccagtggggtatctgccatcttcacagaacatcacagcaatgagagaatactataatgagaaattgatagatatttttcaaaaatacagtgatgtcattgcaggacaattttatggacacactcacagagacagcattatggttctttcagataaaaaaggaagtccagtaaattctttgtttgtggctcctgctgttacaccagtgaagagtgttttagaaaaacagaccaacaatnctggtatcagactggttcagtatgatcctcg

SEQ ID NO: 2366 - DNA, 728 bp, Homo sapiens
  misc_feature (1)...(728): n = A,T,C or G
ctttgacccctttcgantcggcacgaggtgaaagcggggcctcacgatccttctgaccttttgggttttaagcaggaggtgtcagaaaagttaccacaggggccagaacttccaccttgtggtcaattgtttcaagtgtgtgaccatacttgtcaagaaagtcaagtcttaccagataactgaaaaacagctccaagttctactggcctatgctgaggaggacatttatgatacttcaagacaagccactgcctttggtcttctgaaggcaattttatcaagaaagctgttggtcccagaaatcgatgaggtcatgcggaaagtatccaagttggcagtctctgcacaaagcgaacctgccagggtccagtgtagacaggtttttctgaaatatattcttgactatcccctgggtgacaaattgagaccaaacttggaattcatgctcgctcaactgaattacgaacatgagaccgggagagagtccaccttggaaatgatcgcctatctctttgacacgttccctcaggggctgctccatgagaactgcggaatgttctttatccctctttgtctaatgacgatcaatgatgactctgccacgtgcaaaaagatggcatccatgacaatcaagtccctacttggtaaaatcagcctcgagaaaaaagattggctgtttgatatgggtaccacttggttttggagcaaaaaaaaccgcttaaatagac

SEQ ID NO: 2367 - DNA, 1109 bp, Homo sapiens
  misc_feature (1)...(1109): n = A,T,C or G
cngngcntgagnggnnggntatnngtanntaacnatgatngttaganatanctncgttgttcncnanctgnagtanctngacncnntntatcngncntgtnnanagntngaangtagggganagtcnnnccannnganttgaaccccgtatcgtagggtgtaccccanacagccancatatncnttcaaatacanggaatatnngtgngnnttaaaaaatatnaaaccatcattgttnntgtnacacaangggaggngngtgnntacatnngaaaanaaaannncttntggaaaacnnaggaaacnntngngggnannannagactttttgcatgattagttatttncnnagncntnngnaaaannagggaacttatnttaaacctnggaggtgtaggctgcgntgcnantcantttttacnctcacnagngnagggngcnccaanntgggggtgnnaanttgttaacccgggnnntgnnnntaataaacgagaagnnctgtanntttctccnaganataccngggtgggnaannncgatanatgtgnaccaatnggaagnctanttnnacttcnctagcccgtggctatncttggngaaancgannncncttcnatgaactatcccccaaatgcnngtcttnntctngagnnatttggggataangagtttnnnaannnaaaattattngcgggtntagggggcttcgggnaaagtggggagggcntgatcggttnagggttggagangggactaaaanggggggcgggnannganaatnanccttgggtnctcttntgancnctggggggggaatggcaaaaaannnggtngagcncagaantggccgccttggggnngggggncnagncttggaatcccantcntagtggccgggggttctgacccaaaaanccntcctgaanncggnanggntntctaccanatgggggggngataaatanangcccncngnggnanncccaanttttnggnggaaagggggatnnntnnaantctcttttgggggancccccagaaaagggncttggngnaaggaanncncncctananaactngggagaaanatgttncttancgcccctgnt

SEQ ID NO: 2368 - DNA, 754 bp, Homo sapiens
  misc_feature (1)...(754): n = A,T,C or G
attatncnntcagctcttgttctttttgcaggatcccatcgattcgaattcggcacgaggaagcacacctttnncnnncnccccnngagggccgnggnancntgaantntggcttttntnntgtaaagattgancttntgantcggctacagtctcaaagggcantgcttctgcagggcactgaaagcctgaaccgggccacccaaagtattgaacgttctcatcggattgccacagagactgaccagattggctcagaaatcatagaagagctgggggaacaacgagaccagttagaacgtaccaagagtagactggtaaacacaagtgaaaacttgagcaaaagtcggaagattctccgttcaatgtccagaaaagtgacaaccaacaagctgctgctttccattatcatcttactggagctcgccatcctgggaggcctggtttactacaaattctttcgcagccattgaacttctatagggaagggtttgtggaccagaactttgaccttgtgaatgcatgatgttagggatgtggatagaataagcatattgctgctgtgggctgacagttcaaggatgcactgtatagccaggcttgtgggangagggaggaaagatgaaaaacccttaaatgtgaaggaacacngcacaagaccagtatgatttccaaggtaataaatgctgtttatgacttctttaaaaaaaaaaannnnnnnnnnnnnnnnnnnnnnaaaaaaaaaaaactccct

SEQ ID NO: 2369 - DNA, 733 bp, Homo sapiens
  misc_feature (1)...(733): n = A,T,C or G
ntttaanccccgntcgantcggcacgagnttgaggatctcgaccttgtccttccagcaggtgctcccaagccacctctgggcctgagaataggcatcacatgactctgtttaatcctccgacacagcaaggatgccgggaagcagggcaaagtggttcaagttatccggcagcgaaactgggtggtcgtgggagggctgaacacacattaccgctacattggcaagaccatggattaccggggaaccatgatccctagtgaagcccccttgctccaccgccaggtcaaacttgtggatcctatggacaggaaacccactgagatcgagtggagatttactgaagcaggagagcgggtacgagtctccacacgatcagggagaattatccctaaacccgaatttcccagagctgatggcatcgtccctgaaacgtggattgatggccccaaagacacatcagtggaagatgctttagaaagaacctatgtgccctgtctaaagacactgcaggaggaggtgatggaggccatggggatcaaggagacccggaaatacaagaaggtctattggtattgagcctggggcagagcagctccttcccaacttctgtcccaccttgaaggctgaggcacttctttttcaagatgccaattaaagagcacttttatgagtcaaaaannnnannnnnnnnnnnnnnnccccggcccttttaaaaanttaaggggngggctt

SEQ ID NO: 2370 - DNA, 765 bp, Homo sapiens
  misc_feature (1)...(765): n = A,T,C or G
gatngatcntttgcaactnccgttctttttgcaggatcccatcgattcgaattcggcacgaggtttgaaatgaatgccatattaaatntttncttttttcctngncntatgggggttaatttnaaancnncngggcctnancgngttttttaanctttggtagtaaatgancntttgaaatccattttgataaacctgctgttaatgttttttccccccttgtgaatgttttctaacttntcttggtaattgcaatttaactaggtgcggtggctactaaagttcgaaggcacgatatgcgtgtccatccttaccaaaggattgtgaccgcagaccgagccgccaccggcactaacctatgaccttctgacctctgaactcttcacccaatgatgacctgaccatgcctgcctgctgatcaagttaactggtaatcgcctttgcttgcctgtcgtcagtgcagcgagctgaggcacttgtcccgttcgtcttaccatctaaccaaacaaaagacaaagaaattgttgtcctccaactcagctttttttttttttcctgtttgggtgaaagtggttctagaaactgcactgaatagtagtaaagcaataaggcccaattcatcccacagcactgatcatcttttaatatcccaccctaagcgaacggtaagaaggcctctcttaagaaggggagacagatgggccttaactactcaatgacagangcaggttactggggagaaaacttctaggaatctttttcttn

SEQ ID NO: 2371 - DNA, 732 bp, Homo sapiens
  misc_feature (1)...(732): n = A,T,C or G
ntttaaacctngatcgantcggcacgagtagaagaaacacacagaacaagcagcctgacatgtaacagagcaggaaagcccccccatgtccacctctacctcattttgtcaagtcttcaagagacctccaggcccagtcactgtgaattcattcctctgggtttaggcactcacctccccgccaccccagagaggtagcatattaaatcattaacagaatctaatataaaggggccctgtgattactgggaacaagttctcctgatttatatgcgattgaaccatattccctggagtaggtcctttagagctataagcccttgccatgatcagcccccagcatcttctctcttactcctctacaggggacttaggaaaacattttctgagtcttacccaactttagcttctgctattgctactttttgatgctgtgcaagcacctgttgactcagtggttctcacccttcttggagtcacagacccttataagaatctgactgaagccatggatcctttcttgataaaaataaatacacacttaacatttttcgtacaatttcaaggagtttatagacacacttctaaactcagtcatggatacaggttgagcaatgtgtaatgagttgcagtcaaaaactacacaaaattggtacttttttaattttcanaaagggggtcttgctctgtagtccacctgggagtgcactgggtgtaatcataactcaccgn

SEQ ID NO: 2372 - DNA, 982 bp, Homo sapiens
  misc_feature (1)...(982): n = A,T,C or G
nttatncttcanctcttgtcttttgcaggatccctcgattcgagagtgagaacccctntgctncaaaaaattgaaaaancctnttgggnnttgggccccntntnnnttgaaccacttgttgnaaaaantgacntggnaggttggttngancccagaaggccanggttgnaggnagntgtggtcncccnattgcantttaccntgggtgacanancanaaccccttttcaaaaaaaaccggccggccgtgggggttnacncntgtcttccaancattttggaaggttgaggcggttggatcacaaggtcaggaaatcgaaaccttcctgctaacatgatgaaaaccccgtcttctactaaaagtncaaaaaaaataacttgggtgttggtggccggccgccttgtagtncccacttacttcaaggaaggcttgaaggccanggaanaaatgggccgttgaaaccnccngggaaggccnggaaaccttttgccaantngaagcccaaaagaatccggtggccccactttggcacctttcccaagccccttgggggcccgnaacaaggaaacccaaaggnaacccccccatttntttcaaaaaaancccaaaanccaaaaaaaacnttggtgggaattggaattaaaaaaaaaaagnccgnccccatttaaaaaaccancnttaaanttatttccaaaaaaccccanttggccttaacnttcnttggtccnttttaaaaaantttttttccaaaaaattaagccntttttggccanccccttggaaaaatttnccaaaaaaattttaaagtttttnggggaaaaaaaaccaagntttttttnaaccttggtggtttgcntcaccaaagccttaanttnaacttggtattnaagnttcttgnccttgttgaaaaggntnaaaaaaatnaaagttcantttttgggaaaaaaaaaaannnnnnnnnnnnnnnnnnnnnnnnnnnttt

SEQ ID NO: 2373 - DNA, 1738 bp, Homo sapiens
  misc_feature (1)...(1738): n = A,T,C or G
aaacncngnanncgngntggcgnggaanaaaacantgtngnaaacnngananacgtacggannanatctcgcaaanantnngagnnannngnnnanangaatnaatcanannttggntgnnntggactnnnngagcgacntgangnngatgtccnncgnatagtcncgcngcgtggncagcgngannanagnaacatgngtnnccgcgccncccncncgcncngtttttaanaaacccctcggaaaanngggcnncnccagnnngaaanangcggatatcnagncacngngctgcanngacccgngngtacggngggatcngctnagagtggnnggnggngagggngaaantttttttctcnnanaccgtccnaagnannannacnnnnnncgggggnnntatngnnacaacantcannnanccannnnnttttgncgcgatnganangagnaacggaccnactnctnncatcccnnnaancngnntgnatnnnngggnnagtngtanaagagnganactngangagacaganngnnacngncnnantnaagnntggntgnncggcgganngcgtgaggncannctnggnattcgcntacacnaaanntnatagagnnngatgntgnagaaantnnctnnnannngnnngcgtataaganngcggngaantcnngnnnagcntgcnncgtcgnnacngactgcggcgncgtncngntacatcctatnanctgncgnancngcnnancangcnnnngngncgnnnncgntntnntatanggngantnggaggactngcgcngactnancgnanctnnacgcaggngatcgacagancacanngagcgagcacgcacangngacatagtgcntcnnngtacgtagtntggacancagatcacgagcncgtcacnnacncgtncanacatgagctcngngggcacgtggnnatcgtagangngcannganagcntacgngngngggagnnngananatnncgnatgtncganacnnagnanagttntcatgcacatcgagtgangaanncgataangnaangncgatcgcntgtagaagttcncacanggtntngcncgacntangtcgagangtacagaagagnaacgntnatncngnngtaatgngcgcncagacgcgnnaatanagcagacgctcgcggatttntacangggngaantgtcangantcagangaagtgtcggagatgcncnaanatagacatgcnaagtacgatagcggncgcacgggaggancnnantgggatgncagantaaggaagtgananacgcgctcgtacacacgnncttagannaccgtnncncantncanacttgantgtgagancgcnctgatgatanncncgcggnnanaacggagcngagtangannancgcgaatnngntgcngaatanacgcagatgatacagatnncncacgngagagtnnanagacnggcgnactcanatcggagacnctgcnnancnngaacatgtacgncgctncacaccacngtcagngcncgcannntgtancgctgnagtncgcgncatcgcnacgcgatacgagcgtaacnnatgcagctgcggcgtgtntatgagatatntgnnngngacannngnacngantnngattcatggngacgtacggacactggnngggggacgannctgaagagtncncngtnaananctangcgcncgcacgggngcncaacgcgn

SEQ ID NO: 2374 - DNA, 735 bp, Homo sapiens
  misc_feature (1)...(735): n = A,T,C or G
ntttnacccctntcgaatcggcctctctagatcttccccaggccactccttcacactccttactagcagcccctgcttacctccacactacggcctggtgacctggtccatggtgctcgccctggtgcttgaagcctggcaagccccagggctgtccttcgcagctgcttcaggtgctctgtcccacccatcaggcctttcttttggcctggctgtcaacgtgtttcccttccttgattaaatggtgttcaggcttcatgtccttcctcccgcagggagccttccctgatttcccacactctggcccctcacctggttttgagctcatgaggcaggtgaggttggatggccctcatctctctgcacacagggcctcttctaggggagactgagccccaggacaggggcaggggctccttatttctgagggccctgctaggtctttcctcctctggccccagcagaacacagcccagcccacttccacccttcttcacatgtaggtgggcctggggcgtgcctgagtggtctggttggtgtactccaggagcaggttctgagtaaacaccatctctctctctccactcgcactctgctgaatgtccaccccaagcaagtgtcttggtcagctgggagcttctgataggagancagcttcagggagagtgaaaaaggacaccnttcaccctgancaagatgtgggacattggtgtcaacttccggctgcanaagggn

SEQ ID NO: 2375 - DNA, 1111 bp, Homo sapiens
  misc_feature (1)...(1111): n = A,T,C or G
cgganctgnccncannncccanaagccncgggcnggccccnggcggggncgacctccanangggagcccccccttgngttnnccnaccnncaangncagaanccnacggcgnnntttttttatcancaanaannacccaacccaccgggggggggnttanttaaaaaaanccnaaancccnnnntaacccnancacccgccccnacancncaanaaaagagacaccacaccgnaanaaccacaaagggagancnnnaccagacnccanaacnnaaaanacacnccacacacaaatagnaanancaccccgcccaaaaaacgncngaanaaaacacnccnacacagnnnaaagcaccanaanancaacagnacnanggnnaangccaccancntcaacnacccnnaccnaaaaaaanaccaaacaanntncnaaaatagnncanacaccccancgaacnaaaccannnancancgnccacganaaaccaannaannannnanacacaagnnncagcacgganaccaccnangagcgtnnaanaaggacacaananangncccgagaaacaacangggnnacnaananctcgantgngnngaaaccngaaaantaccccaannaacngganccccgtaaaacaaccaaacagacnngcggcccaaaaacncanggnaagagcattacaaacacaacaaacncagaccnnagnananacaacaaannnacnantacacgaaactgcacaccnnaagnacaantnacatacaccancgaaccnctcnagaaagcactnatnacggacnanacnnganatcanccnnnaangcactacacannaacatgcagagcnnnnaacacatancacaacannngcnctcacaaaatanancacaacnacagccancaanngncanaacacaccgaancggagntngcccataccangcaannccacacanaanacanngagnacnnccnntacacganacanaccccanaacnaancccgataaaaangcgtnnacaanccaaaacacacntanacgcgnacgagccgacacacaaagacgacaannnncaccaagcgannaccacngnaaaacgcgcccg

SEQ ID NO: 2376 - DNA, 771 bp, Homo sapiens
  misc_feature (1)...(771): n = A,T,C or G
gacnactccgttacagnctcctggnnnntttgcaggagcccatcgatncgctatagtgngccctctgaaatggacctcannggaaaattngtttggngttncattanngctnttncnccngntngacataattacttctaccgatgtgaatgatacggatgccggcagagcttccagatctttcagactcaactgctaggtcaattagtttgtcataataaaacttggcagattctacaagtctattatgacaaaccaggaactaattctataatggaaaactatccattctgaataataggtatgtaattatttgctgctgctgctgtgctctgtaaaattcttgaatatgacatttaaactctgtgcctactaaaggtatcttctggagtttttgggaggagagaaactggaaaattaaattgtatttttgccagaagactcttacttgcatgtgtctcagggtcttcagtttttctataagtttccatatccaaaggttcagaattcatgtgaaatcttctttggggcaaaagtccttcattcctggtatttattggattgggaaatctgtagcaaagatgctgnttaaaaataccatattgggttttttatcttatccttagctctctggctattgacttccttttcttgnttgaagttagcttcaaatttgctctatgctaaatacctgnaaaatattctgggatagggaactacttgaaatagtaattnggtaaaaagatatgaccaaaatgaaaatncttaann

SEQ ID NO: 2377 - DNA, 730 bp, Homo sapiens
  misc_feature (1)...(730): n = A,T,C or G
tttaanccccgntcgngacattngnnancgcgtctgntnnaancactactacgcttgtggttgcacacangacgaaaagtganaatgcattngcatgacacagcattcntaggtccggcactttngttnctnnnccnnnnttnnnncagctgtanngatnaatanatcnnccttnngatagccctggtgncctctgnctnctgatntgatncgntactgtgtcagtgtangcaatcagancgcgnctcacctncacatacatgtttncnnaatcaaggtctctacagctcatcctaatcancattaatnangtaatnggctatnncgaacataatgttntctgcangaangaaagtnncatantnanganaatggnggtggataagaacagatataatgaataacngncacagctgtannactttnattntgnnttattgcnaacacgccntaactatcctgtgnganaatgggaatntnnantcccatcttgcaattgctatgttgcatgcagggttaggggcctgaaagcatgcaagaanngaatgccatgtgatngggnttatcctggattcacaanaatactgtnatngcgagccanatcccncantggttgananttctaatgtcgactgtntgcnggcncanaacatgattgctttntaattctnacaanaggctggccngtaagtacattcttgnctagagtcttntgcacactttctntacn

SEQ ID NO: 2378 - DNA, 727 bp, Homo sapiens
  misc_feature (1)...(727): n = A,T,C or G
nttaaaccntgntcgaattcggcacgaggccttttgttgtgaagttgctcatcatttaggagtgtttaattctaaaaagccttcagcctaagaaagcttcatctgtggggaccagagacttgttgctcagggagttagtgatgggacttgggcatctgatctgcaggtgacaagtttagttcaactgaagttgtagggaatttagacagttgcacatcattgccgttctaggggccttgtagaaagatgaaacagttgtttttcatttaccagcacctctcagttatagaggtaatggaacattcgcttacttttcatcatcattctttaaaaagggaacatacaaaaatctaaactatggcaataatttatttttataatagtttacggtaggctttaattaaatggcaaactcctctgggacccctaagttatggcgtgattagccaaatttgatttccaacagtcatttatggccataactattgcatagagtgcaggatgccagcaaagatgagggtgggggcagatactggctcagtgatttaactcacattatagatgaccccttnctcaacagaaatgctactgagagaaccagaaaagcctgggccaggcaggtcttatttgagaggagattatttgataattgctttggttagaangactttacatttcctgatttcaagtccaccaccaatttagaaagttcagagatgaaacccct

SEQ ID NO: 2379 - DNA, 962 bp, Homo sapiens
  misc_feature (1)...(962): n = A,T,C or G
atgnnnnnnnngnnnnnnnnnnnnnnnnnnngnnggnnnnnngnnnnnggggggnnntngnnnnnnnnnnnnnngnnnnnngggnnnnngngngngnnnnnnnnnnnngcctnggggnnnnnatanannnnnnnnnnnnnnnnnnnnnggngntgnaaaancccctttttncccaagaacctcccccttgggggggnnctattttttntattatttngggncacncccccnattncngnnnnccccgccganacnaannngggatggntatnnntngnngtgnnngaannnagagggagatgtgcnnntcnnanntntttntnttttnggtnngntagnnnnntngntncnanntngntcannnatnggtnnnananngggggggggggggggggttttttntcttttaanannnnattgntgctnntntntttnntnaacccncntctacnnttcangcggnnatnggcnnantntcngatnggggtnngtatagaagtnggnctgttttnnnnngatnnncntattnnggnnntagnggcagnngttatgngnngtgttnntggntgtggacnttngtncanntatnttntttannntttcntttntatnnnatnatgagngnnggtgtgntttngnanntnatgagngnnntanannttngtcgctnggggnatntntntngnnaggntnnnnatntnttnnntnnttgntntttnnngatgtttgtnanntnngnncnnntataannngtgactngtattntgnnnnttggtnnctcncttncnnagggtnntnntngagagtggtatanggnnatntannngagttantngnngnngtntnnctangtanngacngngnaannngntgnggnggggnnnaaanaaggnggggggnggggntatgntannaaangntgtntaacanntttnctatggggggggganggagnnttnatn

SEQ ID NO: 2380 - DNA, 909 bp, Homo sapiens
  misc_feature (1)...(909): n = A,T,C or G
tntnnntcgcntntctnnantnannnataattatntttttttntntttacgnnntnntgnataaccgtcntgnaactgtanttntgnttgtccannatcagganatannncncnnnnnnnnnnngaacccttngantangcccacgtacnatanctngtcttaannacaaatttatnantaatatgggtgcacaaagaaggctttantggcttcaagaggtatgngaccgctgccgaggnctttgagcttgangccaagatcgcagttgttgaaaagtataacatcaggattccagagctggtgcaaaggatagaaaaatgccatatagaagattnggactttgcagagtacattctgggcactgtgcacaaagccaaaggcctggagtttgacactgtgcatgtttttggatgatttgtgaaagtgccttgtgcccggnataacctgccccacttccgcacttcanagttgagtcattttctgaggatnaatggaatttactgtatgttgcagnaactcngagccaagaagcgtcttatcatgaccaaatnatttggaaancattttganttnggcttggggagtacttnttgcnagcagagcttgactancaccgtnttaaaaacaggcgtgggttgcgcntgctgngtgggacaatgcaacaatgccatccntgttgacaccgtcctttaccattgaagaanctgccccntctcntttagccancanggaaagggaaaacaanngggggggcttacnttatggntcanntnctngagccgggangnaagctgccattntgnggccccctgggcgttnccntnacanantctttcnccngaanccatggtggccctcccctagggtaannggccaactggtggggagtaaacatnttntntncttcg

SEQ ID NO: 2381 - DNA, 756 bp, Homo sapiens
  misc_feature (1)...(756): n = A,T,C or G
attatncgntcnncgcntgntgcntntgcangatcccatcgattcgcagacagncnaacngaccttttgggttnatgggaccggnnttgtattntngngntancccatttnaagggggcacntccaacggnnatgcccacccnacgggacggccttaattatgacgangtcccgnncntnancggntcgtgggaaccggaanacggctttcntgcttcctgcagcaaaggcttgggagaagaggtgctttatgataacgcaggcctgtacgataacttgccgcctccgcacatctttgcccgctactctcctgctgacagaaaggcctctaggctgtctgctgacaagctgtcctctaaccattacaaataccctgcctccgctcagtctgtcactaatacctcttctgtggggagggcgtctctcgggctcaactcgcaggtacggcatcttcttctgtaagattctagaccaccttcaagtcacattgctccaacagagttttgcaacttgtagtaaatgggactcatcaaaggcaaagcataatgtgtttttttttctcaactagaatataatttgcagcctgactaccaaggaactgatgagatatttctaacgagctcatggtttatctgaaccactgtgttctttgcccacatctggctctctttctgtcttgggaaaattcccagtgaaaatttgtgaattatgtcaactaaaggcagagaanttaaaaaagaaacnggtnataaaann

SEQ ID NO: 2382 - DNA, 726 bp, Homo sapiens
  misc_feature (1)...(726): n = A,T,C or G
tgaaccncgntcgantcggcacgacaggaataatgctgacatacatacatatatatatatatatgaagagagagagagagtcacacacagacagacagacacacggagtctcgctgtgtcgcccangctggagtgcagtggcgcaatctcagctcactgcaagccctgcctcctgggttcacactattctcctgcctcagcctcccaagaagctgggactgtaggcgcccgccaccatgcccggctaattctttgtatgtttagtagagacggggtttcaccgtgttagacaggatggtcttgatctcctgacctcatgatctgcctgcctgggcctcccaaagtgctgggattataggcgtgagccaccacacctggccataatgctgatattttagttcagggtcatgcagtcaacattacagatgttgtgaaggactacatgttcatttgtccaaattgtccctttaaaataaggagattacaaacaaatatttgaagctctttgaggaggggcttttcagatttaaagtgataaaccttattagtctctctttaggcagagaactgaagatacatgtatatctcaaacttgtgagtgaaattctctttcagactttaacattgaaaagntaatttctaattctttctcatatatncatgggcattggtaatgatgtgccgaanatgtcctgtaactttgagaaanggagaaaattatatgat

SEQ ID NO: 2383 - DNA, 856 bp, Homo sapiens
  misc_feature (1)...(856): n = A,T,C or G
tactatccgttcagctcttgttcttttgctgatcccatcgttcncttcggcacgaggagatgtgtcatcctggtgaatgtccctttaactgcaaccagaaggtaaaacttagatgtccttgtaaaagaataaaaaaggaattgcagtgcaacaaagtacgtgaaaatcaggtttcaatagaatgtgacacaacgtgcaaggaaatgaagcggaaagcatctgagataaaagaagcagaagccaaagctgctcttgaagaagaaaaacgaagacaacaggctgaactagaagcttttgaaaacagactgaagggtcgtcggaagaagaacaggaaaagagatgaagtggcangttgagctatcactatggcaaaaaacataaatattatctcatttcagtgtgtggagtttgtggttgtagtgtttgcctggtacatcacccatgatgtcaattaaaaaaagttttgatcttttaatgtaactcagattggatttagataaagttgttaaatttgaaatattagaaaatgtntattatagaacatgatatatatttacattcatctctgtattccctcagcctgttgtttagaanggacaggaatngtttaaaacttttatctttaatttagngtantacctaagaaaagggggccaggtanttaattaccttggttntaaaaaggtngaaaagggccttggaacttggaaaaaccttnaaaaattattttttccattnanngggcttttaaaccttangangggcccaggaagtttaaccgnggntnttttgggntncatttgggggccttccctttggttnccnttaagnttnttttccatttttaaattaatnc

SEQ ID NO: 2384 - DNA, 733 bp, Homo sapiens
  misc_feature (1)...(733): n = A,T,C or G
nctnacccttttncnngaggtctacaacccattagggcagaatggaggcaaatgaataatattcccttggtctcagagaccaacaactacagaattatcaagcatggccaaaaattgttgctcatcacctctcgcaccccacagtggaaaaagaaccgggtgactgtgtatgaatatgatattaggggagaccaatggattaatataggtaccacattaggcctcttgcagtttgattctaactttttttgcctctctgctcgtgtttatccttcctgccttgaacctggtcagagtttcctcactgaagaagaagaaataccaagtgagtctagcactgaatgggacttaggtggattcagtgagccagactctgagtcaggaagttcaagttctctttctgatgatgatttttgggtgcgtgtagcgcctcagtgaaatgcacaggatcaacagggtttgttgtaactagattgaaacactaagttgtttttactgttttggaaaatatcttaaatatcctttttgttcctaaaggagaggaaaagttgattaacttctggtttggtttagaaaaagtaatgtttgaaatacgaaggtaatttaatgttacaaattttaacactcaaatcaaccttttaataattttctgtgctaagggtccaggtattttaatttggattatttaagtatggttatggtttcatggacacttaatttaggctttttgatn

SEQ ID NO: 2385 - DNA, 759 bp, Homo sapiens
  misc_feature (1)...(759): n = A,T,C or G
ganatnctttcaactcttgttctttttgcaggatcccatcgattcgaattcggcacgaggggtcaaaagaaaccacacgcttagattggtaagagggcaccctatgaaatgaaatggggatttcttgagtctcttttttccacgtttaaggggccatggcaggacttagagttgcgagttaagactgcagagggctagagaattatttcatacaggctttgaggccacccatgtcacttatcccgtataccctctcaccatccccttgtctactctgatgcccccaagatgcaactgggcagctagttggccccataattctgggcctttgttgtttgttttaattacttgggcatcccaggaagctttccagtgatctcctaccatgggcccccctcctgggatcaagcccctcccaggccctgtccccagcccctcctgccccagcccacccgcttgccttggtgctcagccctcccattgggagcaggttggggcgagctggangcccgggctggaggggcagtgttgctgttcatagattttgttccattgncgttgctctgttgaatttaatttcagtcttcctgaatcttcccttctgtnaagtgtacattaccaagttccttgnttttttatatatatatataaatatatatatatacaaactgtctctttttgcctttgacattcaggcaagaaganaaaataaatctttttaanaagacaatccnaaaaaataaaannatanaaaancct

SEQ ID NO: 2386 - DNA, 1107 bp, Homo sapiens
  misc_feature (1)...(1107): n = A,T,C or G
gaagacnctntcaactnctggtgcttttngnnagncccctngcccntnttngncganganatctnaggtctataagacggntnttttnnntcnaatgccaannntnnaagggggggnngnnnttntaagaatnngtnggaannnntngcncaaggaatgnncnaanctnnnannccaanantatggatnaagggttggacagggctttncnanatgnatnctggnaaaaagcntntggntgncncccaanccttgacccggttccggttnaaaggggaaaaacctaaagaaannngnttaagntngtttcgcatncngtnattcnagcnngagnttacagaagnttantntttccacaaaaacnaancatgggccctaacanaatnaangggnanccnncgggcncttttttngggtatccttggggttcttttcnaacccaaaaaaggtnnancaatnncnattcccccaantncacccaattccgnncttnggnccntttcacccccccnagncccccnattgntcnggaaacccanccctttctattgaaacanatngncnttnnnccntcctttttaaacccncgntgggggccttggccccggttccaaactttcccttctnccnattgggnttactgccttggcaantactcggggnaacatnggcaattggnctttaaaatngctccananaanccttttaagtnggccttggaacccaaagtttnnttttncaaaatatgngaaaaccatgtatcnccggccttngggtaaaaanaaatgtggccaaggatataaaattgggttcccccaatgnggccngggcccccnctaanaattcctntccaagganntnnttgnccttggggnagaaaatttttttagggggtannccatacnancatttagngggggccaggaancaaggnangggtttccccantggggngcaatatntctagtnaaagcttaatgnttgggcaccccccnaaccaatggaaganaantttgngggaaangggataaaancnannaaagtccnnaatttatnnngggggcctaattntgcccanggggaaanaactanggggcaaganaaant

SEQ ID NO: 2387 - DNA, 724 bp, Homo sapiens
  misc_feature (1)...(724): n = A,T,C or G
ctttaaaccttttncgcctttttctccgacgaccaggagccctaccctgtgactgatatttcggacctgatccgggattcctatgagaaatttggagaccagtctgtggagcagatcgagcacctacgttacaagcacaggatcagggtcctccaaggccacgaggacaccacaaagcagaacgtgcttcgagtcgttatcccggaagtctcaattcttcctgaagacctagaggagctctacgacttattcaagagagaacatatgatgagctgttactgggagcagcccaggcccatggcctcacgccacgaccccagccggccctatgctgagcagtaccgcatagacgcccggcagtttgcacacctgtttcagctagtctcgccctggacctgcggggcccacacggagatcctcgccgaaaggacgttcaggctcttggatgacaacatggaccagctcatcgagttcaaagcgtttgtgagctgcctcgatattatgtataatggagaaatgaatgagaagattaaactattatacaggcttcatatccctccacactcactgaaaatgaccgagacagccagtcgccgttgaggaatnctctgttgtcaacatcgagacccctggttttcgggaaaccaatggtgatgcagttgattatcagaaacagctgaagcagatgattaaggattagcccaaaaaaaaaaaaaaaaactcn

SEQ ID NO: 2388 - DNA, 966 bp, Homo sapiens
  misc_feature (1)...(966): n = A,T,C or G
nnnnnnnnnnncntnnnnnngtgnnnnnnnnnnnnnnnnnnnnngnnnnnnnnnngnnnnnnnnnnnnnnnnnnngtaagaatcctttcanctcccngtncttnntgcatgaacccatcgattcnaatncggctccgaggnnnnatntgantantacncacggcacattntttttcagggggaangngaacgaacgcctgctggggagtgggctggacntgactgttncattgcaaagncanaggtnagagcctggcgcagnancatngactcngnnggatccantgnangcnnnncnaggggccanncaggaagggncntcaagnctatttcctcatacgcaccgggatgacatggatgatgntgacagggccccatancccnntgggaaagtgaagncananaaaggncagggnagtggnantaggntncagggggtgaggnnataaaantaatantactcnctgttgnaaaactcctaganggnaaatatngcntgaagaaatatcacgaannatgggaggaatcnnnatcgtttatatacncggttgnttgaaaagancnatnaccnnctgatccacataaggncttnntnnacngggatntcctggaccggnatggcnctcancnngnaacagnttccnaaccngggnagggcangcnncccagggccttnaatncnangntgccgggaagccantcaacttgncgncaaaatnaggaacttgggcttgacctggnttgnccntccnnaccgcgntngantgacttggatggganacatacaacnggncnttngccatatggtcaggtggcaccngggtnnnttttttaaccatanncagaacccnagggaacgttggngtanaantccncnatagcccagtatttggntattctttaanggggcggaacctcagntnnaattttttgggtccaaaaanccntggttcccnnacatannan

SEQ ID NO: 2389 - DNA, 1130 bp, Homo sapiens
  misc_feature (1)...(1130): n = A,T,C or G
tnggggngaaangcngangaannggganannggggctnacgannacggggnnatnnnnnggnaannangccncgnaanangtaatncgngngncncccncatgnaangtnangganncnntagcgcnganggnncgggcanatnnngacacacnngcnngcgtttnnanngtangnnacnncgnataacagcncnnncntgtcgtagnnaccaancnnacncnnacnangcttttgnaaacncntctcangcgccccccgaacgcnaaataantnatgncgnccccccccngaggngncnactgnggaggggggggggggnacacntttttaccaacannnccaacccannngggggcggtnggaanaacccantnnctnntttnactncncntganggtggccngngntggacggntaancaaacacnnngcgagagctnncgccaccgagcnagngncnagaggaccgnnncgntcgagngngaganaagggngngcannnctgccgnngcngnngagtctgngatggcgcncnnccnnnagcggccgcaccggnanngannggnnnnnannannnnagggaganaatgngnaggngnaannnncngnaannagaannannggtgncngaagangganngnagnacngacgccncgngannganggncggcngnntngggcgggaggangnnangtgtcgangngnggcngntnccncngacacgcggggtagttgtngcgacacgnnntncagcannaannganaccactcacancagattangctgatngtnaancnngcgcggcnnngagnaacggcncangatncactngtnngcggggnnagctnnacgcgtcanagcgnnnnnntcgcggcgcnagngggccgagnacangnaagggancgaccgagtcagtcgnangncgtnaagcncgcancatcggagactgncacaaacncgctcaggaacnngnngtctctggnacagcaagctgcgacntgtngcnganacagngnacgncaananggngaaaannnggcggcgcacngaggcgncgcgnngtgcncgtacgancntgggagacanccncgagatncgacnnnctagagtgccagnagagcacncg

SEQ ID NO: 2390 - DNA, 901 bp, Homo sapiens
  misc_feature (1)...(901): n = A,T,C or G
tcntncnccctccaanctccgtgctctttgcaggagccctcgattcncntagatgaagggctganaattttanaaaaagcgccttnanaagcctnnnnagnattnctnggaaattattggngnccaaagcccctagncngnttngggnnaggcaccnncccatggntntaaccccgttcccaaaaaccatngtnaaanncnttaggattcnaggtttggaaaatcttttttncgnttanttggtanttnncttcccaaaaacccccnttaaaatagccctcctttcaccatggctatctttttttcaaggttttatatgcantagctctctcagcaccttggaatnggnaaaaactggtaccagcanttngggaggtgggtttttcttttaagaacattttgccagatctttatcttcaagggnggactaaggaacccccagagcctaagttantcttggnganggcaatctctgcgaaccgcctgaaccttaccctaagttgggtttctatggaaatatggtagaaatgccacctggcaagtaancccatttggtaaggaanggtacctatacccgggttttttttgggggcctttgntnggttggttggtttggggtctggagaaatggtactggccnacccccttctttttattaaaganaaagaaacctggatttttggataccnttattttttaaaaaatattgaataggttccaggaagtttaaatngggatggtttaaaaaatttttaatttncttttggtttnggggcaagttnggaatttaaaatccggngaaatccttattaaattccggtnccctttttgggggnaanttnttnttanccccggntttattaaataaatacctggggcccccaanccnnttttgnccttn

SEQ ID NO: 2391 - DNA, 732 bp, Homo sapiens
  misc_feature (1)...(732): n = A,T,C or G
ngttttgacgncctncgattcggcacgacttanaaancgaaaacctggcgctgcaaaatgtgcaggctcgaatacggatggtcctctcctatctgtntgctcagttgagcctntggntntnggggtgtncacngngggctcctngtgctgggatccgccaacgtggatgagagtctcctgggctacctgaccaagtacgactgctccagtgcggacatcaaccccataggcgggatcagcaagacggacctcagggccttcgtccagttctgcatccagcgcttccagcttcctgccctgcagagcatcctgttggcgccggccaccgcagagctggagcccttggctgatggacaggtgtcccagaccgacgaggaagatatggggatgacatatgcggagctctcggtctatgggaaactcaggaaggtggccaagatggggccctacagcatgttctgcaaactcctcggcatgtggagacacatctgcaccccgagacaggtcgctgacaaagtgaagcggtttttctccaagtactccatgaacagacacaagatgaccacgctcacacccgcgtaccacgccgagaactacagccctgaggacaacaggtttgatcttgcgaccatttctgtacaacacaagctggcctttggcagnttcggtgcatanaaaaatcaggtgcttcaacttcgagcctnttnaactatagtgaggtcgtattacgtn

SEQ ID NO: 2392 - DNA, 760 bp, Homo sapiens
  misc_feature (1)...(760): n = A,T,C or G
nttgactcgntcgnttccgactangttcntcatncatgacaaanncntgaatntgctnccagatggtaggacatgnacctngaccttgggaanacncaaacnntngtntctgntactgccctnccacantnaccnnaatattacnngcactgccccagnngattgnnggccncnctgnctnnctnctgtgtgcacnccngnaaagncngggcctcgntntccatntcntacctnncactgcattaagnagatggnnnngtcccgccctgacctgagtctaggcgngctctgctgctgngatntgaacananctcnaacctnnacagnnactgncgggatnctannagtgtntaatncccatgtggcantgttgcactgttgcnntccatgngntncatggncaaagcataaccttccattaactantgaaaccnttntattggttgtangtcnngtnaataatgatgggtactatggctttaaaacttttttcacatgctngcacctctggatngntnggnanaccaaagcnnggtctttaaccgcgcctcantttnaananannngggagncnaangcttnnatttntncntanncggaaactnncanctacannttnnttggcaacnatnccatngcannncccttnaattngggngnaagngaaaanggctnccctggnnnnaaggaactgggattttttnaaccctngaaacgnananaaanngcgggnggtnggcncttccnctttttcncccct

SEQ ID NO: 2393 - DNA, 741 bp, Homo sapiens
  misc_feature (1)...(741): n = A,T,C or G
tatccttcactcttgtcttttgcggatccctcgttcgaaacaagcnacctntnntngtgatnggaattgnnaattnaaaaggnggntnntngggtttnggccaccttaaccaccaaanttngaantggtngattgaggnccgnngnccntgntgaaagggnccntttggaangggttggggnggaagggaantntttccgggtgggtntgaanctgttggctttccaggtcantttttgcccntncanccntncttgcaggatgatcagaaatcacggcncctcattgggaaggttaagactggaccaaacnttttccaagggtgagcatattcaccgttacctgggaagtctcttctttcccacctggggctaatcaggttaccaatttttcaaggggtaaaccaaacttacccacttccagggataggggaaagtggtggtgggaataaagaagaaccattgataccctgganggaaggggaagaaacccccaagcctttttcctactgaaaaaataagggtgacatgtcagtcaaatcttgatcaactgggacttgagtttncagttaaattcctacactaggagggagtttctatcaaaatnctcagattgaagaacttggttattagaaccanctgtccttttcaaactgttaaaatagatctgnctcccctangatgatcatggcctggtggggccanaatccgngtgtttgnacctgtgcgatttatgcataaa

SEQ ID NO: 2394 - DNA, 914 bp, Homo sapiens
  misc_feature (1)...(914): n = A,T,C or G
gntattcnntcagctctngttctttntgcangatcccatcgattcncccggctgaacacctcccancatgccatgnacnnncntcggntggnngagannngaggggncctggnntaangntnagttaaaaganctctggnngatgtancccttcctcgccttagggccttaatncntnacttcntgtcncggttgcncntngaanccnttttccntggaancatancaaagcaggctgcnttaggaattatgcagatggttgaagacaccctcattgaccatgctcataccaaacctctccttccaagtcagcttggttcggtatagaagaaagttcagctccctgacagaagggatnggttttggtttatcaagcagaagaaaatgaaagttcaccaaataacctggtgggcantccgagnatattacttaccccaaaccaggaccattggccaaaagccacccttcaagaagaaaataatggtttttcttgggaagncttcntttcttggtccaagaaatttaattcnttcnggggaaacccctttggccttttcaaaccaaccccccttggcggnccancccnaaaggggaagcccaagttttgggggggccttattaattccggtccnttttcnaggccgggggccccancggttccgnaggccttaaatggggccattaaccaagggggctttnggaagnaatttcattcaatnccaagtccaagaaaaaagcccccctcacttaccctaaaaaagccagaagtgggaagccttctttaattaccattgggaaaaagtccataganggacatgacagaagangccttncaaaacacatttcaggcattagcaattcgtcgactagaccaacccaagaactntctgctgagtgtgctaaaactggggana

SEQ ID NO: 2395 - DNA, 728 bp, Homo sapiens
  misc_feature (1)...(728): n = A,T,C or G
ntttacacccttcnaattcggcacgagagatagtctctgaatttagaactgggacgaaagtgtacataatagggctattataaaatttttagaattggatttctaaacttggggtcagtgaatctagcaggcttaagcagtgttctcaggtttttctggcacagacaaggaatataagaggaggagagaaaaggagagacagtagtgggagggaatagaatgagagaagatagaaaatatggaattaatagagaaaggatacatgaagtattacaagattttcttggaaaaattggcatttcagtgatggatcaaagatgtctaatgaggcaaaatactactattacttaaatatttaatgttttaaagatttgaggataaaaggatatagatctgatggcgttcatactaattgctgtagtgttgatgttggagagaggggtaatgtatcaagacagagcagacagaccctttacaatgagagcagaagatatgttgtttactgattctactttcccacaaaatgctaatgcttttataagtccctcctccttattttctagattaactccttgtttcttcctctaaacagaggattatggcagacaggcaaaaaaaaaacctntanaactatagtgagtcgtattacgtagatccagacatgataagatacattgatgagtttggacaaaccacacccttatnnnnnnnnnnnnnnnnnnnnnnnn

SEQ ID NO: 2396 - DNA, 1632 bp, Homo sapiens
  misc_feature (1)...(1632): n = A,T,C or G
acnncncgananaagnnaacnngtannnananntgcgtaantngacctncaanncancgngaangcacgatagtanganctacannnacacgcncgnacngcnnananncnnncgnccacangacgcgatcncaannaactnagntggnagcancncncnananagactnanactatacnacncncannnnannactngggaaaancctnttgccaaaanancccccngncgcgganaaaagatacngncnancnagagannagtcncntanaacacggcatnaacnnacancgtngngggagngntnngacnntntntttatanagcngcgnactcacacnaatnccncncnnncgagggnggggnggggcgttnaancanaagngaaatncnccngatnnntnanctcgancacaccnacnctcagaanagcncnntatntaagnganntnnaaccttggnagcaaaannnnntaacnannaccncncnacatnntaagaatnnnaanaagncngcacancaanaanccaanatacnnantcggnnanngcngnnnataacnngncgnaggtnnnaagaanancannncnngagacatcnncaacaananaacncncannganangatnngangnnncnnnnngncnnncnantccganctntcnancacnnntantgantntacnccaggantgatcacacgnnggnnnatgaagatanactccanncancacngctganaccnncncanagnacngtataagctnatcacncaacnntcgtntcgnggtnaacnnatntntannntanngnngcgcgtatnngagcanacatntgacacatannannanatcaagaccggcatnaccatgaatnacngaggnntcncnannacacagangcaagacngacatncgtngcgatanttcgccgngananntccnnaanaataatcgcgacgcanaaanatgagactacncnacaaanncacnttanaataancntgaatancanagnacctgcgnttataaacagnnancnnnaangagatancgatcaaanccccgnangntccangataactcacgtncatgnntgtcgaccnaaatgacaancatnanacgagngacncgaaacagaantcagacggcgnnntantnaccccatntcgtcatntcctnctntntaacgcnactnttnagcnnnacgtgncngcnacagcnantanaaccaccaacatcnccatangtcgctnagacaaaacgaaaccgnancntatanccnngnncattccacgaanatacnanacncatcatnctcagtagctatgaancgcgacgcncanatagcaanaanacnctacatacacgcgnagactagancgcaaanntacgcactnantagnanatnanaaccacgacntacagaacaactatcgagcacgcctacantgcatgacatgacanacncacnngnacgagtanaacatanntgntnangtcntaacgagcanacacgacgaancacgatnnaacancgnacacaacnantcantatcangntacgcagcnntnncncggcacntaagngcananaccganacacctnanacgtcncgcatcnnnncgcg

SEQ ID NO: 2397 - DNA, 957 bp, Homo sapiens
  misc_feature (1)...(957): n = A,T,C or G
tntaatnctttcanctcttggtctttttgcangatcccatcnattcgctgcactgtgaacctgggcactccgcgccgatgccaccggcctgtgggtctctgaagggaccccccccaatnnnactgccaaattctccggtttgccccgggatattatagaaaattatttgtatgaataatgaaaataaaacacacctcgtggcaaanaaaaaanaatntaattaaantanaattaaatnanaaattctcngnncntttaaaantntaantngantctnntttnctnatanatccnnaaanatcgntnantattcctttntttgnaggntttggaacaanatccccccattcttagtaattgctanctgtaaaaaaatattncnttttttttnntttgaanttnttnngtgaccccccttccgtctcttattttgntaancccntttttttaanccntgttanttnacccaannttataccngacnaccantttggcaattctttttctantngttaccnagngtctnctggtgtngtannntncttttaaaatttttttttaaatttctctncgggtctccnctgnntnccnatattncnatctggggccctcgngctnccccnacntttttatttttcccntttttaannnatggttttttattgtctcnctcttggntnnctaancncnttggancattttccttgnnttncttnttnganaaaaattggannantactgcttctccaanttcnaacattaaanatnntcnaatctngtngatcnattaatnnctnnnataacgctcntggtnanngtccncanttcttctcntntcnttaaccttcctttttnattgnatgatcggnncccnnatctgcncccnnntaancncnttntnnganaaatcccntcacntctcccatatntntttttnngtaatctntcctccttctt

SEQ ID NO: 2398 - DNA, 777 bp, Homo sapiens
  misc_feature (1)...(777): n = A,T,C or G
tattattcgttcaagctcttgttctttttgcaggatcccatcgattcggcacaatgtctacccangggatgtntgttcctgacctgncgcccaccttctatggtgccntcaagaacctnggcaccaaccaatgcctggatgtgggtgagaacaaccgcggngggaagccnctcatcatgtactcctgccacggccttggcggcaaccagtactttgagtacacaactcagagggaccttcgccacaacatcgcaaagcagctgtgtctacatgtcagcaagggtgctctgggccttgggagctgtcacttcactggcaagaatagccaggtccccaaggacgaggaatgggaattggcccangatcagctcatcaggaactcaggatctggtacctgcctgacatcccaggacaaaaagccagccatggccccctgcaatcccagtgacccccatcagttgtggctctttgtctaggacccagatcatccccagagagagcccccacaagctcctcaggaaacaggattgctgatgtctgggaacctgatcaccagcttctctggaggccgtaaaagatggatttctnaacccactgggtggcaaggcaggancttcctaatncttgcaacaacattggggcccattttcttttcttcacaccgatgggaagaaaccattaggacatatattttagcctancgtttttncttgttctangaaatangaggcttccaaagtangggaaaggcancctngggggangggttcaagggct

SEQ ID NO: 2399 - DNA, 901 bp, Homo sapiens
  misc_feature (1)...(901): n = A,T,C or G
ccccccncccctnatgncnnannannncnnnnnaacnaancncannggcntnnntnananatntnatatgganaancgccctaatannccnccgtacannnaccncncnnacnnntgaaacccttcgaaacncacgagaaaaaanaggaattttggngcgggttgaccgagggttantgtacanatnnggaaaaaaagctcacggggtgggcaggaagacaagcctatggatcntgctccangcatcaagctcatntacatgggattttctggncnctnaaaaacaatcaggattgcnctagacattcgaaaggcnngcantntcntctcttntgttttaacctgnanacangctgataaaagtcctccacatctcagcttacatttggattcanagncgntgncnacggagggtgagagcagaaactcttaagaaancctttcttctccctaaggggangaggggatgatctttngcggtgtntngatcaaacttntattttncctagagntgtggaatgacaacagcccatgccattgatgctgaccagagaaaaactattcaattcttgccantagagacacatccaangctgccatnccaaaggggtcaaaaagttttcaaataacngtggcaagctnaccaaaggtgggggaaagcatgataagcttgcaggttatggtaggagagggngagatataaagacatacnntactntaggatttttaaantatnaaaagncaaaaaaatccatnagaaaagtatcccttttttttttttgganaanggggtncntccacttaangtnggcccagggcnngggtcttggnannctcccnaaggccnnnaanggganaccnncccccanctnggggncntccacaaangnanntcggggnt

SEQ ID NO: 2400 - DNA, 699 bp, Homo sapiens
  misc_feature (1)...(699): n = A,T,C or G
ggcttnagantgcaatgccaggggtgccttcccaaaagttctttctgcctgggtggagcgtagacagctcagcaccccacggggggcggttggaccagccttggttttgttgggtaaggatgttanaaagaggggcgaagacccatagccactggtgtgaagggtctgctcttgaccgaagctgcctccctctgggtgcagaccagcaggtggtcccagncacggtgccctggggccactgggtctgtctgccctcaggctccactatacacacctgcngaggcagcanactancancggtgtctgtgaggggcagntgcacagtcccctntngagggtgntcctaancgttggntaagcccatgcgtttctgctttttggggagcagagcctggagtcctgncattgttggggaggaagctatcncatgcttgagcgcgggcctggggtgctgacctgcatcccaagancaaatttgcccctggcctttctgggcctgncctttcttgtaacaccacacttgnacacctgggancanaagcgtgccccccggcaggatcccacantggctggtnggaacactnngggcagcangtgactnaggtcnccccanaacttgagggaacaccttantccanggaggangctgaagcttccanggacacaantaaacaangtggggannnggancctcacaat

SEQ ID NO: 2401 - DNA, 1344 bp, Homo sapiens
  misc_feature (1)...(1344): n = A,T,C or G
antnaaattcnnntactcaagcttgcattgcctggcagggtcggactcttaggagggatccccccggggttacccggaacttcggaatttccgcccttantaagtggaagntcngtanttaacaaaatttcnacttgggncccgtcngttttttaacaaaacngttccggtggaacttggggggaaaaaaaaccccntggggcggnttaacccccaaactttaaatccggccnttggcaagccaacaatnccccctttttcggcccaagcttgggccggtaaataagccgaaaagaanggccccggcaanccggaatcggccccttttcccaaacaagttggcgccaacccttggaaatggggcggaaatgggaacgccgccccttgtaagcgggcgcaatttaaagccgccgggccgggggtggtgggtngggtttaaccgccgccaagccggtggaacccggcttacaactttggnccaagcgggnccccttaaaccggcccccggctttccctttttcggcnttttttcnttttccccttttnccnttttttctttcggccccaacggttttccgggcccngggcntttttttncccccccggtttcnaaaagggcctttcttttaaaaaaattccggggggggggggcctttnccccctttttttaaangggggggttttnccccggnaaatttttttnaaaggtngggccntttttttnaaaccgggggggnaaaccccctttttggggaaaancccccccccnaaaaaaaaaaaaaaacctttttggggaaattttaaaanggggggttgggaaaattngggggtttttcnaaaccggnttnaaaattngggggggggcccccaaatttcngggnccccccnttgggnaattaagggaaaaccngggggttttttttttttcggggncccccnttttttgggaacccggtttttgggggaaaggttccccaacggggttttcctttttttaaaataaagggggggggaaccnttnttttgggtttnccnaaaaaacttggggnaaacnaaacaacntttcaaaanccccttaattctttngggggcctnaatttcnttttttggaatttnaatnaaangggggaaatttttggnccgaantttcngggccctaattngggnttaaaaaaaaatggaagcctggantttnaacnaaaaaaantttaaacggcgnaaatttttaaccaaaaaataatttaacggctttaacnaaattttccttgggaaggccggggantttttcttccnttaacgccaattttgggggcnggggaanttttnaacaaccccggnataatg

SEQ ID NO: 2402 - DNA, 733 bp, Homo sapiens
  misc_feature (1)...(733): n = A,T,C or G
ntctaaccctttcgaatcccacgagaccacgtcatatacagcctacaaagagctcttgactgtgagctcgcagaggcccagttgcnttccactgccattgacaaagagggtcgtcggnctgttaaagcgggagcttatgctgcttgccaggaagcaaaggangatttaaagagtcattcagaaaatgtctctcaacatccacttcatgtagaagtattacactcagagattatggctcatcagaaatttgctttgcgtcttggtcctggatgaacaaaattatgagctattcaagtgactttaggcagatcttttgccaagcatgccttagagaagaacctgactcggagaatccctgtctcataagcaggttaatgctttgggatgcaaagctttataaaggtgcccgtaagatccttcatgaattgatcttcagcagtttttttatggagatggaatacaaaaaactctttgctatggaatttgtgaagtattataaacaactgcagaaagaatatatcagtgatgatcatgacagaagtatctctataactgcactttcagttcagatgtttactgttcctactctggctcgacatcttattgaagagcagaatgttatctctgtcattactgaaactctgctagaagttttacctgagtacttggacnnggaaccaataaattcaacttccanggttatagcccagggacaaattgggaagagtatatn

SEQ ID NO: 2403 - DNA, 769 bp, Homo sapiens
  misc_feature (1)...(769): n = A,T,C or G
nnatccttcaactcttntctttttgcaggatccctcgattcgaattcggccgagggttaaaggnaaacntccagggntttttcggaaatttnattnggaaagggatncgctttttgagggcaaaatngccaatctgcttgcctttataagccngtngatngtttaaatccggtttacccagtttatagttnccctgggtgctgaaaggtntnctggatgatncctanccancagagaaccnttgaatgccgttcaaaatggactgaancatcancaatgtctgaaaaaggcctgacagtaatgtacatgtcaaatggcccgtaatttaagcagagtagagtaagtagaagaataaacatggggaaagttccagcaacagaggaggctttgagcttttgctcttcatcttgagtggatgttgttctcaggtggtaataggccatcgagctttctccactggctgctctcttggggaacaaataaccgaaaagatactcagcaccctggttggtacataggtggtcagttgatttatacttcctggntttcagtgttgcttgaattttctaaatggaaacacagtacctttataatcagaaaacaatcccgagttttgatttgagggtgtttgtaaaaagttnaaaaaaaaaaaaaaaaaaaaaaactcgagcctttanaactatagtgagtcgtatttaccttagatccngacatgataagaaacattggatgaagttnggncaaacccccaactttgaatgccagngga

SEQ ID NO: 2404 - DNA, 736 bp, Homo sapiens
  misc_feature (1)...(736): n = A,T,C or G
ttttaacnctttcgaatcgcacgaggagttctacaggtggagtgtggggcccagaaaggggctcaggtcttaggggtgtcatctgaaaaaacagagatggttgatggggacaccagttctagggagccctctgcatggccactttctgcctcagctcttctaaagcatttcttctgttcccttccattggggtaaccactgatctgtcttcccaaaaactgagtcagaagttggactttgttacttggctcatctacatttaagatatagtcagaaaaaaaatgcagtctttacatcttaagaaagcttacatgggccaggcgcagtggctcacacctgtaatcccagcactttgggaggccaaggtgggcggatcacctgaggtcaggagttcgagaccagcctcaacatggagaaaccccatctctaccaaaaatataaaacttagccaggcatggtggcttgctcctgtactcccagctacttggggggctgaagtgggaggattgcatgagcccagaagtgggaggttgcagtgagctgagacgagatcgcaccactgcactctagcctgggtgacagtgagaacttgtctcaaaaaataaataaataaataaaatccattaaattgccnannnaaaaaannnnnnnnnnnnnnnnnnnnnnnnnnntnnnnnnnnnnnnnnaaaaaaacccccntnaaaaaanantnnggggnnnnttntnnnnnaccccn

SEQ ID NO: 2405 - DNA, 802 bp, Homo sapiens
  misc_feature (1)...(802): n = A,T,C or G
antctatctctttnaactcccgttctttttgcangatcccatcgattcgaattcggcaccgagcgttnangggttggngaaaaggcctttttttncctnggtgggtgggncccgttnnnggccttcttnnnngggncaacccagaaatgtntgttnaanccattanggngttccanaannncnctaaaanggnataaanncantcttcaaatcttaagggacctttccttnctncagatncaaanncnagancttgagggttncagggaancgaggtatcagttncttcagcttcgacctgcncaganagcatcatggattggttatgctattgcttaccatttattagaagattatgaaatggcagccaaagattttagaagaatttagggaaaccacaacaggacatcccctgacaaggtggattatgaatatagtggaactactcttatatcagaatccaagttcttcgggaagcaggtctctatagagaagctttggaacatctttgtcctatgaaaagcagatttgtgataaacttgcttgtagaagaaaccaaaagggggaacttctggttgcactatgtcgtttggaaagatgctgccagatgtttatagagggattgcaagagagaaatcctgaaaactgggccctattaccaaaggcttggaaaaaagccactcaagcccagcttaatatgttagaaacggcttaaaaaattatgangganccctggactaaatattcccaggggactgggtgcccaaaaaggcttgcccgttnaaacttttttatctggngg

SEQ ID NO: 2406 - DNA, 1160 bp, Homo sapiens
  misc_feature (1)...(1160): n = A,T,C or G
gncgnnggnnggngangngggngnanngngnnggngggannggnggngnnngangnnnngannnaangangagtcgnannnnnnnnnanngggaanngnnnngnngntnnananagnnggatganggggnnangggaaantgggnganggggngnganangaagganganananagngagggaaagcagnggagngnnnnnngcgngcgnnnggaganngngtannganncnncnnngcgcncnnnncccangttngnngaaaccnccgttatgcggaaaacncggccctnngntnataggnnngaccccngggnncgnncccgcngggagnanngnaaanantaacggggnggggggggggnagnaaaattttttttcngatagnnnngaggancggnggnnntggggggggagcgcgnnagnnnaggaanccggggnattntgnggncnanngcgcngnagcncaggngcgnnggcgaagaaaggncantcaggantggcggaaagggcnnatgncgananggnggngngnnnnnnagngnnnaagnnnagggnnncgagnggggnaggggcgntcggggagnnggggaagagggnngtgganngagggnagtggngaancggnggnngcaccgaaanngnggaganngngngnnngngcanngggnncacgagncggggngggtnngagannggagncnngacagnacnnntnataannngcnggnnggngaacgaggagnggnnnaagganagcngggngggnngancnngcnntnnacggnnggngatnatgcgcgcggnaacggggngnnnngtgngagncgcgngangtnngtntggatgcacgcgngangggnntnnacngannnanngnggntagggngangaganngnggcgagctagangggacgagaggatggangantgtgngngannngngcaangcgnatangagtgcgncgagggggcnaannatgtnngtcggacgagngngacggacgnganncacgagcgngnngaggagcgtngggngggnacaactgggagacgcgcgcgaaggggtngannangaagtaacgtgngagacgagggggttagnannacagngagcgcagnggnnngangnncgngggnacgaggngnggnganncgcgc

SEQ ID NO: 2407 - DNA, 756 bp, Homo sapiens
  misc_feature (1)...(756): n = A,T,C or G
ntaacncnnnttnccngagcatgatcccangncctnttcacctctgctntnncctgacgnngttgtatnagtaacngctattctaacagcctcngttcagacangatgtccaatggtgncntttttgcctgngctggggngcctcatgactgntggcccgnnggantnaactgcctgtgtactccaggactcatgacaatnctgtaactagacctgccgcaactcatggntcgtatgatcattctattggatctncaggggcangggagganganatccccattntgctacngctaatgngcaccnnctgnnnaaaagggnannnncganctnganntgnnncccatgnttaaanactctntgcaaggcnngcccgttcaaccatttctnatnnntccnacgnannnngtncntnncnnagactgattacnacntggtgtatntgggtagggcatgttccaacggggcctctctcatggntaatggggcatcggggaaancacagaatactttgccctttaatanngatgatacanatcaggatatccattactcacatgtgtctggcatgcantanctacgnngctncnantgtctnnctttctgganntnttttgaattgtanaaatgactttggccctaaaattcttngctcagnggctnctagctgtgtacaccatttgaacacatgtttnaaanaatatcccacccacnctnncttngcttcagnctntggncaggtatgaacctnttcan

SEQ ID NO: 2408 - DNA, 808 bp, Homo sapiens
  misc_feature (1)...(808): n = A,T,C or G
nctatccttcaactcttgtcttttgcangatccctcgttcccctccgcacgagaattaattaatgggcccngnttaattgcntnnctccnncaaaaggaaattattggngcnaattnnccggccaccccacagaccgggnnangataanactgtgtaaccngngcttgtgncaaananctanttttcagaanctccagggaactcaattcancaggaaaaataattaatcccaccaaaaagtgggcaaatgacatgaatagacatttctcaaaagaagatatgcaaatggtcgagaaacatatgaaaaaatgttccaccatccctattcattagagaaaatgcaaattaaaaaccacagtgagattatcagcttattccgtctagaatggccattattagaaagtcaaaatacaatagatgtttgtgtggatgtggtaatgcttatacactactggtgggaatgtaaattaatacaacctttatggaaaacagtatgggagattccttaaagaactaaaagtagatctaccattcaatccagcaatcccactactgggtatctatccaaaggaaaagaagtcattatatgaaaaaagacacgtgccacaccttatctttattgcaggacccatttcacaattttccaaagatattggaaccccaccttaaatgccccatttgacccaatggaggtggaatataaggaccaaccgntggttgtattntggtatnataccccncccattgttnatactaccttcagccccttaaaaangggaatggaagttaatgttggtttttgcacct

SEQ ID NO: 2409 - DNA, 1425 bp, Homo sapiens
  misc_feature (1)...(1425): n = A,T,C or G
cnccgnaacnanaatggcganagagctngtaanccnnnngcanattcatctgcggncgnncnccancgnaanaangnnncacanngangtgccaancngaannaannannnntngngaaccntggnagaaccccacangaactnnaaaagcggccnncccagnncaancngncnggngnggggggagagccgaanntncanggtcananagcagccgntancngggcccgagngcnatagcagnccnagtgggancgatattctanngggcccnnncnaagctgggggccantnacnnnttgcgnggnagntnagcanaggcccgtgggcnagcncagntggtcnanncggagcgnccnaccnaagaatcggngnagcaaacggnngcnancgaggaaccaangggcnggcgnnaaannnatntnaacaagggtaatgaaaagaacagggntnanggangaaaannactnngggnnnggnagcnnggccctgaccanngaangaaagtggggcngnnnnccgnnannnggncgnaaagcncccnnanccccntnctgnannnnggacnnggctagccaanntncncctctcacgngcgnnnctgcnaatcgcatgcgnngngngggtngcaacagcgagaccnccatcacnccctatnncnncgcncanctntacgatcgctacatccacggtntatagcnnnctngtngcgcancgnacgnnggcncanggngnnnacttgcnggntcncgancngcngangggggncaanaagacgnctgnncncgcncnctatacatcncacaacacacgcngaaanatngngagtgancgggaaaaacacacngtntncncgnanacgggaanacatncggactnacacacatcgcangactganggcgggancgcacannagngcangagacagaangtgcntnncncncgannaggcncannntnangaanagntgacagnaccacacnnnncnctgtcacanccnatcgcgcacactatagcncacgcgacatacgaancncataacgtgnacacatcnccaccgnagagatcacacnccagactctagagaacgnctcgnngnancnctcaacaggagnagcancnccgcgggagaagangagatncccnnctncntccctgtnagcnngcgcnaantgtngncacggnngnganccgcnagancncgancnnnacgcnnnngngntncnangncnngcnnagcnacttaacgtcgcccanccgntatntgcacanacnacnnntntntaanngcgacgnccganncncangnaagtcnngnanagcgctangagcagcancgacatgtngccncgnaccgcccnnntatannacncncatcgcntcaacanngagagaatgcgagctgcnntctgtaanctcnccg

SEQ ID NO: 2410 - DNA, 1125 bp, Homo sapiens
  misc_feature (1)...(1125): n = A,T,C or G
cancnnccccnnnnaannnnnnnnnngngcnnnnancgnannnngnanncnnccccanccnncnngccnncnnccangnaacngnnnnnccanncnacgangnccnnccnnnccangangncnnnncgcncannccncncncnnncccgncaccgcgncnnacacnccnnngacncannngngtntcacnaactcgccnnncacnncagcacanncacccccacntcgcnctccanacccgacgcaccacanctcngnnaggcanccnntttgtnntcgggnaaccccctnncgcagcnnccngntnggacnngcccanaccncgcagaacncacacaagcggcnacttcagcngcnncngangnangacnggggcacagannnnntgaanaagacaannanngatccncggtcangnggcnagcnaggccnagcccgaccacggagcataagcgtnnanaanggcnagcactntcncagntnngaagccngcnagacctnggcnatataaaatagcacgnngacacggncaggagcagagggngtgcgagnagganangacnaggancggcaccaccaatcagaaaancagaccagcacancntnaactgagcnnaggctnatgnagccaggcactatactnngagnggagcntngaaagacacncanaaaaagacangangccnanaaggctaaggncagcggctnatagcccgtaaacnncggcacntnngagagaccangggnggagcancnaagngccagggagtgccgagcaccagncangngcnaactanngggggacaancccaaccatnnacananaagacnaaccacnagccngaangngggggggcnccacacncngcagcncaggccaantctggganggacnacagcggggnnaaannnaccngganccccggganagncanggccngnngnagagccaatngatncgggccactggncccacancgnccggcggcgaccncnncnnnaanagacgncnncaccanananctncgcnctnccancccggcgngcncccanatnncangnnncaagannccanacnccgcccaaagnccacccncgcnccgngnccncgggcccnnnncccct

SEQ ID NO: 2411 - DNA, 763 bp, Homo sapiens
  misc_feature (1)...(763): n = A,T,C or G
anntcnntttgttccanacccgaattccgttgctggtcggtttcttaacatttctagttgtctgcaaccatccctgtcttacattacattattaagttagttctattacaagactaatgaatgacagaatagagcaaacatggactttggagtcagacagacatgagtcagataagagttcaaacccactgactgccgtaaacttgggcaagagatttaaccctgtcagggcctcagtgtactcattagtaaaggtaataataagtctgtaggaaataatacctacatacttacatttgacatatatttaatgctccagcttaataaggttggagtattcgataactgataaaaaaccttgcacagtattgagcaggtaacagacattcagtaaatggcagtaccattccgatgatactttanatgcttgtgtgctatactgttcaagaaccagctggaaaagacctcaggttacctccagggtagggataacatttaccttagagtttttgttttttgnttttttgagatggagtctcgctctatcacccatgctggagtgtggtggcacaatctcactgcaangtccgctcccangttcactcccttntcctgcctcagccctcccgagtagctggggactaccnggcacccgccaccannccccagcntaattttttgnatttcttaagtagnagaccggngntttcattgnnnttancccaggatggtctcgatctcctgacctcgtnaatccgccccc

SEQ ID NO: 2412 - DNA, 754 bp, Homo sapiens
  misc_feature (1)...(754): n = A,T,C or G
nnnnnnttttacncgntcgattccttgctgtcggccaagggctccactccagtcccttgcctgtcaatcagaagatgctcagaggagagcttctgcatcatcttcatcttgacattccaagagcagtaccgggtcagcatccacaaaagcacactgtaaaactgggaactgtgtcttacccttcctgagtgaaaagggaaagtttatgcctcagcctgaggcaggtgggccccttgccatgcacacctttgtcctgcagccagggatccacttggctgggctcaacccttccccgtcagggacgactgcacagaaaggagcgcggatagcagcaaggcccgccacggggaaggcctgcttctgtgggtccccctgtgtggctggcagggagtggtacggcgctgggagtccagaatcactgaggacacggaaagcttcagcttctttgagaaaactcagattttgtaaatgcgcatccagttgacagcacttacggtggaatccgtggagttggacttgtgagaagccttgccctganggggttcttggctggtgtctgtcctggangtggatgccttgatggcttgtgtctcccgtgctcccctcacccangtcctcatcctcaggactgtgagacgccgtttggaccttggangagcctgangagctcttggctctgtgggtatggtctgctggcatttgccantttgaaacctgaaggattggaaaatgtctgtataccaanttccaaatn

SEQ ID NO: 2413 - DNA, 752 bp, Homo sapiens
  misc_feature (1)...(752): n = A,T,C or G
nnnnnntttactcgntcgantccgtgctgtcgccttgaatatgtaaaaatacctatcatatcagtgtaatactatcttaacaatcctaaaaaccaggaaagaaaagcaaaatacagccaaatcaatgtcaagaattcttgggaaggctgggtgcagtggctcctgcctgtattctcagcattctgggattacacttgagtccaggagtttgagaccagcgtgggcaacatggcaaaacctcatctctacaaaaggtacaagaaattagcaggcatggcggcgcgtgcctgtagttccagctatttgggaggctgagttgggaggatcacttgagcccaggaggtgaaggctgcagtgagtcaagattgcaccactgtactccaccctaggcgacagagcaagaacctgtcttcaaaaaaaaaggaattcttagaaatatacaccagatattaccatacatatgaaactcatatatagagggttataaacttttgcagatcatttacctgcaacattgttgattttactccatgaattctctattcacattgcatcatagtacacacacctgcaacccaaatataagtaattcctagacagctttgatacatccccagagattttatgtncaattcatccagctaaaaaaaaaaaaaaaaaaaattcctggggccgttttntacgnaaatcccnccntgataagaanccttggnnnantttggacaancccnnnnntnnannnnnnnnnnnnn

SEQ ID NO: 2414 - DNA, 1601 bp, Homo sapiens
  misc_feature (1)...(1601): n = A,T,C or G
cncnnnnnnnnnanancnanacacngcnacancnngcgnncngcncaanagangaacncncgcnnngcnggcccgnnnnncnnnncngacagncgnncnngannacggncnnnnnnggncnaccananccnnncnccgacccccccngagcnacnacnncncannaaaanggcttggaccctntggaagccaagncgnagggaggaaaaantggngcccncggcncgaggggacagcagagncgagnanggtgagacgnggancgaaggcccagggangggcaaggaaggngagacggccnggtcagaangaaannnangngcgaggnagcantgnacnngnccnggagnanggaagagggcccagccgngaagnagccncacangngcnacagcccctgganatgcgtgngnanaaaacacgganannggaccnnactnggnaccnncgactggcnnggcacngccaaanncgccacnggcaggaacnaccacnggggcacanncaggccngagcnnaaggacatcnanacgnangnaanacccgngggacgngnnaaagtaagacannggnnaaaagacaanccggggagggaagaggcggncgcanggnggngcananaagcaantttcnaccgatnaaccgggggngcacaannaggnngggaaccancggcngaaanngaaaacgatngnncnnggggnaagnanggccnangcaacnggagaaacnaccacggncatntgnancnnangaaaaccncngggcaannnccangnnngggcaaacgnggggcacnacgggcngnaccatgnannnaggcctcngnnggggcgccaaaanagaatcggncnnnggganacgcaaagaccgctcgccncagnggnnggaaanaacanaaaaggggcnccaccgggacaaaaaatcanacancnaaaagggggagnnacantctcggagacncgaacnannacnancaangntcaggaacntggggccannananggcnaaacgnangacccacacggggggganagncacncntnagggnntaaaaangacannacaanncgggganaggnnacncnccgggccaannnntntcgggggcccgaangagncaaangcnganntncaacacgcgaaaggggngnngcgcncnccnaaanaggggggaaacnantcacanngggnacaaagcgcgnganctcgnggcgccnangggaaaggngcanngcagnggagtagngcaacacgngcaaaangaaaaagngccgngaaagggccgcggnnaacacagaatncacganaaaaggncngaagcnnnnancnnnggnnatncnaaanaanaangngnncncgcacnncacagganngggccnngcccgcgagagaaangnangccancacagagnggggaccttcnngngggaaccncantggggngcaaccnnnnacaaancagacnngngacngaannncgncacngcnnaccnnggngaaacccntcaanannggccaaaacnnananccnangggagggnnccntananngggccccaaaaaanaanngccnnncagaancnaanccccggncgnn

SEQ ID NO: 2415 - DNA, 746 bp, Homo sapiens
  misc_feature (1)...(746): n = A,T,C or G
nnnnntttnaactcgttcgattccgtgctgtcggtgggatggctccccctatgaaagttgtccagtgagcagggtcaaggtttaggtttggggtacggacatgagtgcaggagccttactctcctgtgtgttgtcagggatggataaaggggatgaagttggaggggtttagtgaatggttgggacagcaaatttcagagaagagcatttggaaataattttctcaaatatatatttttaaaatccatatttgatttttttccctcagggattcccaagcatagtagagctaaaatgaattaatttgggtaaaagtaaagttaaggctaagttaggaaacacttttaaaaacaggaacctgctgcgtgcggtggctcctgccttgtagtcccagcactttgggaggcagaggcgggtggatcgcctgggatcaggagttcgagaccagcctggccaacattgtgaaaccccatctctaccaaaaatatgaaaattagctgggtgtggtggcgcatgcctgtggtcccagctactcgggaggctgaggcagaagaatcgcttgaacccagtaggcagaggttgcagtgagccaatattgcgccattgcactccagcctgggcaacagagcaagatactgtcttccaaaaaaaaaaannnnncnnnnnntnnnnnnncnnnnnnnnaaaaaaaaantnttncnggggccttttttcnnnnnncccccnnnttnaaaaaccntttngnn

SEQ ID NO: 2416 - DNA, 743 bp, Homo sapiens
  misc_feature (1)...(743): n = A,T,C or G
nttttactcgttcgattccgtgctgtcggtgcagtggcacatacttgtagtccaagcttcagaaaggctcaagtgggaggatcgcttacacccaggagattgaggctgcaatgagctgtgatagtgccactgcactcagcctgaatgacagagggacaccctgtctcaaaaaaaaagtcagtttctcacttggactaactactttttaactgttaatagctggtggctgccatactggacagcccaagactagaggctcaatgggctgttctccactctctgtccaagggaaccttcctttatgtgctttttgctttcaagatggggtcttgcactccagccggggcgacagagcaagactccatctcaaaaaaaaaaantaattaaataggccggntgtggnggcncaacgtttatantcccagcactttgggaggccaaggtgggcggatcacgaggtcagganactgagaccatcntggccaatgtgaaaacccgtttttactaaaattccaaancaanttacccaggcntggtggtgcncncctaaagtcccagntaatcaggaggttgaggcaggaaaatcgnttganccaaggaggcaaaggctgntgcantganccaanatcatgccantgaantcaaccctgggtgacaaaatganactntgnntcaaaaaaaaggataancttaaaaaaaaaaannnaaaaaaaaaattntnggggccttttttcccnaaaacc

SEQ ID NO: 2417 - DNA, 833 bp, Homo sapiens
  misc_feature (1)...(833): n = A,T,C or G
tgctgtcgtcttggagctttcatttactaatgaggaacaaatgatagtcatgttatgacaatgtgttataaattaacaatcctcttttaaactagatttataaaacctacacacttgagggtttccatttgttctatctagatgtattttgagaaatctgaaacaaaagcttgntnttttgnttgtntgtttgttgtttgaaacagtctngctctgtcacccagcctggagtgcagtggtgcgatcttggctcactgtaaactcggcctcccagattcaagcgattctcctgcctcagcctcctgataagctgggattgcaggcgcgcatcaccacgcccaacataatgaaacctccgtcttctactaaaaatacanaaaaaattancttgggcatggtggcaggccgcctgtaancccngctactcnngaggcagaggttgcantgagcccnanagtctgccattgcactccagccctgggccgacagcgggagactcccgtctcaaacaaanatnannngactaannnantaaatttccccnggnnantcntaaaaccctncatnngnntttntnncnncnaanttttntccncnctnannntngnttnaanccttnnccnntttttnacgaacnctgctancncaantatgnntccntctttcccnanaaacaatnntggccaattcccccatgnncctattnccacncccttntaaatanctcccctnnaaantngaactcnanttccnnnannncntttncnctccgnnaanctnttcntttctaaaanaattnncgngctctgntcttnnccnnccantcncancct

SEQ ID NO: 2418 - DNA, 735 bp, Homo sapiens
  misc_feature (1)...(735): n = A,T,C or G
nnnnnnttttnctcgntcgattccgtgctgtcgatttttcattatgtctacggaggagtgtctctgttatatcagtaggaaatcaagggggctttttcagagactgngttggttcctttcaaatatttgaaacactgacagaaggagacattttagatttcctcaaagtttacactgcccagttttggggggaggcatgcctagtttctttgaaactggctatgttttccttaatacctgatttgcctttctctgtaatccttaaaataaaatttgttaaaagtgttcttcattatggaaacaatatatatgtggtaaacagtatagaatggcatacctcattcatacttctccttcccagaattaagcactttattctttttctgatgtgatagtttctttctcttagcaatatattttcttctgtttcttgctatcactttatatatgtaattctatttcttgttattacgctaatatatataactacctggcattatgaatttgactcacttaacgagaaatgttctaggtgtttacatggtccagaattagtttgtgttagggatccaggactgtgagtactaaaaacttgatttgtgtgtaggctacaaatgaaaaagttaacaatgactttttaagagaaaacaaatgtagaaaaaacaaaaacacagtctggctcggcctcccaaagtgctggggttacaggtgtgagccatggtgcctggccaaann

SEQ ID NO: 2419 - DNA, 769 bp, Homo sapiens
  misc_feature (1)...(769): n = A,T,C or G
ncncnnnnnttttgaacccctttcgattccttgctgtcgctcagggcacagcaggcagtgtgttagccttggtctcccttgccctccaagtcccacagggcaatactggcaggcccaggaaagtgttacacactgcaggtttgcatgacggctaaggaaccacaatcttagggagatactatctctgtcttctaaggccatttgctgtacaaaaatccttgaaatacctgggcacagtggcacacctataatcctagcactttgggaggctgaggcaggcggatcacctgaggttgggagttccagaccagcctgaccaacatggagaaatcccgtctctactaaaaatacaaaaattagccaagcgtggtggcgcgagcctgtaatccagctactcgggaggctgaggcaggagaatcgcttgaacccaggaggcggaggttgtggtgagccaagatcacgccgttgcactncagcctgggcaacaagagtgaaactccatctcaagaaaaaaaaaatccttgaaatagtctggaacaaaatctgtcaacatctcagcccacaaaagtatcaacaaaattgatatttngctgcatttaaaaaattttaaatggtggtcaaagcgtncaaaattntgacaatttnagacaccccccatgagacacngaatttatntncccaataaaaattggtctnttaaaaaacctggnttcccncaaatatnggaaagggnnnaaaaantnnnaataaaaccntgtggngtcnaatt

SEQ ID NO: 2420 - DNA, 1145 bp, Homo sapiens
  misc_feature (1)...(1145): n = A,T,C or G
gctgtcgcacaactggncagtggcagggctagggatttgaaagcagttcttttccattttggttgttggtgactcaaagtcattctgaactttcagaattcaggtggttgatggggtggggtgggggtgtcagtatgcgtagctcaggccactagactggtctgcgtgtcaggatggccttgtccgttgctgnatgcttagcacatggggacacgtggcagctgcttagtgaagagntgtagggnggatggatgagtggatgggtagatgggtggatggataggtggatagnnnatcggcccccccttcncttcngnccnaantcntntttcactattcttctnncatgtccctntcnannnctntntcttcctctcnacacnntttnantntctcccncncntccatncctctctttnnttnccctnccctctnancnntacccttcaatnccaccctccttctanccncttctccccnctcttcctcctnatcntctccttctatcntccatatcanacntcntnntctatcctcnacnnctcnncnncctccnctccntcntcntacccttatcccnacncatctctctctctactacnctnttcctctatctatncttacctcancntaccatatctnatcacnnnctatcnccntnntcttntctctctnnaccctcnntcagccttctctntantctccnccatctcntttcataccctccaatcnncttntccactcctcnctctctcatncnccntnnanncacctncatctctcanccattatnnctnntacctnctcnctacccctntctacantctnatcactcttctacnnncatcctcncctncctcnntctncacttctncnctctcncnctccnctctctatnatcnctctatcntctctcnactctnttatancngcatcctcttctctccctctcnacaactcatctcctntcctctctctcacacactctctcntcnctnatctnctcgnatatcncacctncncactctanncttcncnactaatctnntcaaaccnntctccactnctactatcactcnctcatnaatttntcnctctctcccacacatcatatccanccantctcnantcnctccatcctctct

SEQ ID NO: 2421 - DNA, 1500 bp, Homo sapiens
  misc_feature (1)...(1500): n = A,T,C or G
cnccgngcannacanacncacgcnnnnnanncncgaggacacgnnacncnnnncacnancacngnnccncnngcacnnanccnnccnngcgnacnncnnancnncnancananncgangncanagcnncnnncangcncgncncacannccncacngaagcanagagnananaccacggccncnnnncanacccgcangnacccggagngcgngctnngggaaccccttttacgnaagacccctggnnggaagaggncgcgngcaggctaccancgggcacgnaacgnagacncaaccgacatcngnaccgggggaggancnngggncacgnncnnngccnggnaagnaggangnccgnccccgaagcgacnccngccnggnngnacggacnaccnnagcacntcanganngngcacgncncagngcgangacaancgcncaccgncacnnncngccgacgggngggaagacnccgaccnganagcgccnccccagatgnggaagcncgagcgncnngaagcnancgcaccnggncgggccccccagggncgcagggancgnnccacannaancgcngcccaggngnagnncccggcacnancncngnnnanacaggcncnanggacagcnncncggaacaggganagngggncacgngaacancngncaacncggcgaancccncggcgccagacnncacnggggnccnngcancaacctagcgnnncacggaaacgcncnccnnggaanaccacgnccacnnacgccgcnnaaantgcgaccngnncgnacacgaangnacnggggcacnagcacnactcngacagcanagngngcngcnngccncnnnagcgntcgcgacacnanagncngacgggncnggnaaannnngggagagcgaanaggcgggcacgcnngngaagcnggactacggccnccgggacnnnccagngagngncnntcgacacggggggggnccacacancacncacncggngaaccgccacacnnannccnccncgngggcnncgacanngcanaccnggnanaaaccggggggcccacccatngnggcanancaccaanggggccggncgcgccggaaaccccncngncgggcacgcncgcaaacgncatangacccnngnncgcgccnggacgnnganggacancanggcncggcaccancnnanatnngngggcacacggcgcaacccccacgnacggncnnaaagnggcacanancnggngnngcangctncacacgncncancngnctcgaggggncgngcacanngggatcagaccgncaccnngngncgcnccncgggngnntnnncccnctcnctnganaacnngcnnnnanaggggggcccacacngacnaanggggcgacgcgcncnntacggggggcacanacnagncgnccagccgnncaccannaanaccacggggnnacgcganaaacnacagnnnccnnnnctcngnggnacaaacct

SEQ ID NO: 2422 - DNA, 749 bp, Homo sapiens
  misc_feature (1)...(749): n = A,T,C or G
nnnnnntttttgaacatcattcaatccnttgctgncggttgtgggccaggaaanaaccagcacanggttaaagtaactcctggcattgcccaccagggggctggtgcacctgctgacctcagggtcacagttgagtcatttgccagttgacggagcaagtttgaccttggttctgttgctgaagcaaatttggaacttttctgtctcagtgtgatccactaacccacaggatcatttggaaccttgaatagctctgcttggacaatggggttggggaatagggttgtctttcctatgaaaatgccatctgtagaccttgtgagtcanccgtccagatgtttgcaggtgaattcctctgcttgacatcctccctgncactttggaccctatgggagtgggcatntccacgcacctgtgtatgtgaaagtcattttacatttcaaagcagtgtgtgtntcttatntctatatttttaactctttattcttggatgtataaagtgaactttttggcttctgtaagtatgctctatgcacctctaatgttttatcatgtatttatatgttgtacacagtactggctgattctgtaaatggatgtattgtacagagaacatgaacgtctcttcctaattttacatcttcagcatcattgcattaaagtggtgtaaatctccttctctaaaaaaaaaaaaaaaaaaaattcntggggccnttttttnctnaaacccaaactttannagaaccctn

SEQ ID NO: 2423 - DNA, 767 bp, Homo sapiens
  misc_feature (1)...(767): n = A,T,C or G
nngtctttttgaacccgnttcgaattccgttgctgtcggaagggtgctgctattgggtctatggaagcttatctatcaaaggagcaaacatccagaaaagtgtttataaagcaaatgtattgcctctgtttagagatttgcccagctgttccagttttaaacattaaaaaataaactcagttgccatggcaaaaatagaatgcacagcttacttataattttccatgcagtatagcataaggatttttgacttgaaacaaccaaagaactcctccttaacgagacagttcaaattcctgaattagtatttcttgactatcaacttaaagaatggacttcctagtacaatgttgcacttatttttctttctgaaataattctgcctgcatgtatgtgttgtgttttagcttctccccttaccccaccccaaagatcttttcttcctaatggttaatgtctcaactcggctactgnttactatcagatggtttttcattagtgaatttaagacctctttgagaaagcttgtatataaaaagttaacagatatattttatggaaaaacccntcttattttcaaatatatttaactgctgttatattntattagagganggttgtaaatattttnctaggagttctattgtaaaagaaaaagtattttttgaaaaaaaaattaatngtaataaaaaagggaaaacctttttaaatagntgggttggcgattgcttcctggttctgggctttcnttatgtcctatttttcnn

SEQ ID NO: 2424 - DNA, 747 bp, Homo sapiens
  misc_feature (1)...(747): n = A,T,C or G
nnncntttttgaacncgnttcgaattccgttgctgtcgggaccattaancctgcctgggtttgaatcctagcattgtcatttacaggtaatatcatcttgggcaattcatctataaattgggataataataccaaattggaacaataatgataggttagttgtaatgattaaatcaaataatgagagtaaactcctggagtagtgactgacacatggcatgtaataaacatttttctttctacgaggtattgatatttattaacctcttaaaagcaatttggactccctttgtctcttattgtcctgtgacagttaccatgagtgcattctcccatttttgtttaccagatctgccccaggaactttttaaaagattgatttctttcttttgaaaataaaacaaatatgtgaaacatactgaaaatgctaaaacctacatgagagtattagaaagtaaagaatgtaattctataatcagctacatatggataggcagagagaggggtctgcttcttgtccagctgtagctctgtgctagtggaagcatgtcctggagttcacgatgtggccaagagaacagatgtagttaggcaatggagatgggacagagagctgcaaagtgctgcacttgccctcttactggacccaaaaggctctcaagtgtaacacctttctgtagtgctgtagatcattaatctgggtgtgtgatgaccatctgatctagcacatccagtggcattgtgcat

SEQ ID NO: 2425 - DNA, 750 bp, Homo sapiens
  misc_feature (1)...(750): n = A,T,C or G
nnnnnnntttttgaaaccctttcgaattccgttgctgtcgggaacatttttcaagcnagaaagtgnctggcttggttctatgaatatgcaggtcctgatnaagttgncgggccngaaggaatggaaaaattangtgaagacattggtgttgaacctgaaantattattatgttagnnttagcgtggaaattggaggctgcaagcatgggattntttaccaaggaagantggttaaagggaatgacttcattacagtgtgactgcacagaaaagttncaaaacannatttgactttntgcgctcacagttgaatgatatntcgncatttaagaatatctacagatatgcctttgattttgcaagggataaagatccagaagccttgatatngatactgctaaatctatgttagctcttctgcttgggangacatggccactgntttcagtattttaccantacctggagcaatcaaagtntcgtgttatgaacaaagatcaatggtcaatgtattagaattcagcagaacagtccatgctgatcttagtaactatgatgaanatggtgcttggcctgttcttnttgatgaattngttgantgncaaaaancncncnggacatnatagcanngaactatntgaagaaaatgcaaacctttcaatttcccacgtgtatncnagctaatgtgatnanggggaaaanaaatccaacggntgcantttcatccntctgaaagactcccntagtncc

SEQ ID NO: 2426 - DNA, 753 bp, Homo sapiens
  misc_feature (1)...(753): n = A,T,C or G
nagnnntttttgaacccgnttcaattccttgctgtcgagatttggatttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggcatgggaggagatggggaagaagatgaaggtgatgaagacaggttggacaatgcagtcaggggccctgggcccaaggggccagttgggacggtgtcggaagctcagcttgctcggaggctcaccaaagtaaagaacagccggcggatgctgtcaaataagccacaggacttccagatccgcgtccgantgattgagggccgacagttaagtggtaacaacataaggcctgtggtcaaagttcacgtctgtggccagacacaccgaacaagaatcaagagaggaaacaacccctttttttgatgagttgnttttctacaatgtcaacatgaccccttctgaattgattggatgagatcattcagcatcncgggtttataatttctcactcttctgccggncangattgtcctgatnggggaatttaagaattgatc

SEQ ID NO: 2427 - DNA, 1471 bp, Homo sapiens
  misc_feature (1)...(1471): n = A,T,C or G
nnannnncccnnnangngnncnnnnancnccnnnnnnnnnnnnncccnncccnnnngnnnnnnnncnancnanggnngacccnnnggnnngnngnanngnnnccannancnncnnngcngacnannngccnncaanncnnnngggngannnnnngnncnncnngncnnccaccngnancnnncancncnngccncancnncccgagagncncnncnnccncncanncncnnnangcagnncncagccagcgncgagtccnnnnacncncgcgatcanngcnanancncgnccnnggccnngcgncgcncctannagnggagngcctttttttgaaaccccggntgcgnaaanagcctggcncgctngcannaanganntncgcncncgggccnncnggacngcgcgnancnngnnngngagggngnncangccaagcaangggacgnacgagggnagnntaaggctggagaagnncagcncgacncccagcanggcggtagcttagcagcgagcggagatcnnaccactgnggcccnccctagggaacagagcgagacggngtnaaaaaagaaaacncggggcgngnagncncnaggggccntgccggcnagacgnagggggaggtncncnggcccggcggcngncanggtganncannggggacacgnggccggaccggngccanagggggnnngccnaggagccngggaannananccncncgngcggngngaaagcnccgnnancncgaanacaggncgcncantannncccacgggnngaananaacnnaanaagaacgngggcnngncanacggnnaaacgangctccggggggngaancaaangagntgccccacggggnnnaannacgggcncnnacanngnnggcggnncagggggcatanncncaccgatnnanncttggacanaaanccgcnaangccccacgnccggngggnngcaacnnagcnataggaganctccngcgngggacgntcncccnngggggaaaaccggacccgncgngnnngnncanccaaancacgnctgccaagacganngggnatgcngcngcgngggcgacacaaacagccggggnnnananaacnnncgnnanacacnccgaannaccgcatanactcganaaacacggcgcggcganaaggagaacggtcnccacagaaancggtatcnnananancannggatnngnnngggccccaaganacgaanagcacgngnngnntngcgccanngcgacacncgntnccnccgctanacgnntngancnccacagatnncanccnngaangccggggccnanccgggccagagangngctcncacagagggggcncgccnccantgcacacantnccgnggaaactcnccncgcaanagngggggggnggcgaccacaaaacacaatnctcgcctcaagccggcggcgcncatnnanaggctccc

SEQ ID NO: 2428 - DNA, 754 bp, Homo sapiens
  misc_feature (1)...(754): n = A,T,C or G
gnnnnntttttttaaanccctttcgaanccctgctgtcctnatacggcccntaaatnggatatccatntcgagatntangaatccaaaccctnntatncggacnaaccattagctccngaatnangtgctaaangaggttctccaantagntctnttatattctatagcctatatnntgantcttgcatccccacgtgtggcntaatnannatcctatacntgnacagctnggagcntgnnntagntccaanccnaatgatncgaggtataanatactaacatcctttgnannnacacaaaagcttgnacctatntatatatntggctatgacngtntctntanngcnctgattnanccntatcctattgnnnntganntatnanncnntnnatgttcnnctaattctgggnccnatgttgaactttggcctaaggattnccttacanagagntantntannnncannttntgncccgaagcntannaggtnaacttctattcttaatncagnccagagannatgattngnactatgtacctnttnttnacggnnaactnnnagantatcctctnngagccntnattgcgatggctgtnacttntttggngtcttnaggaacntgaantnaaagnntgttcgcgnccttnttttctnaggaaacccntngggttttccccatgcctntaanncccgcttngttannntnncccnnattccctgcctaacnntnngccnttcngcnatnccccnc

SEQ ID NO: 2429 - DNA, 982 bp, Homo sapiens
  misc_feature (1)...(982): n = A,T,C or G
cacnntnncnccntnanncnnnnnnncannncncntncnactntnnannnanncctgtcannnntcctnnanaannttancgcactcanntnccncnccnnatanaccatnctaccntnannancatancnnncanagcnncnacnntanccncaccnacnacaagncnaataatantctatccnaaagagcncccttttgaaccccntnncnaaaccccgctgncgacgccttntgcagagtgaaggaccccaactctggactgcccaaatttgtcctcatcaactggacaggcgagggcgtgaacgatgtgcggaagggagcctgcgccagccaccgtcagcaccatggccagcttctgaaagggggcccatgtgaccatcaacgcacgggccgaggaggatgtggagcctganngcatcatggngaacgnggccaacgcttcaggtgccaactacagcttacacaaggagagnggccgattccaggacgtgggaccccangcctccagtgggctctgngcaccanaagacccaatgccngtgtcngagatnaanagggttggtnaaagacagcttctgggccaaagcagaanaaggaggangagaaccgtccggntggaangaaaagcgggctggcccgaggaggccagnggcagnntggagcaggagcgccgggagngnngagctgcnncnangctgcacaccnggagcagcggtattangancagggnggcnaangccagcccnaanagcaggacgtggngancancancncngaangcggnttcnanggaacccnnaanngatcnngaantctgccgtgcaccccganggnagaantccnnaagcccaaangngnanggacangaccnaccaacctatcatcttccaanncctnnaanccggntcnngcngaaggagcccctttcntgcnaaaancncnctcacccaanccntanacaccaactnnggccnagann

SEQ ID NO: 2430 - DNA, 1705 bp, Homo sapiens
  misc_feature (1)...(1705): n = A,T,C or G
cnccacgcacnncnancangnncnacgannnnccnncncnncnnnnnnncnncngnncngnannnngncnnngacngcaaccncangccgnggcgcncngncnannnccanngcgnccgncnncnnncganncgagacnngcnaagcgcaccnnncnncaagcgcgnnccaagngnccccnttggaaacccctttcnggaanaccnaagncgagcngaaaaanncgnngcagaagcncccngggccgcangctagcangcgggagaanncnnanacangaggaggncnggangcancangcanacgnancgagcgngnngngnngngangcgaagcgcggnccccacgaccgngtaccanacnagnggacggagacgcnnggaggngtacnccgannnccnngcgcanggccgcccnagaangacgncngccacacccnnacgacggcnngcanccaacgcanagagnnctgngcnggtgccanncagnncgaangngcccnacngncnggacngaagnannccanagncancancgcccgncaagnccnncgcangcganacaccnncngcancggnnngcgcngnnngcngggcgcaagncgccnannnaaggncgaggncnnagcngggccgnnggacnctnganattngcggaactacgcgganacgnncnccgcagngagcaccacnagaacnccanccgggnganggnncccnananannnggnnccanccgancncgnnggcganaggnaccgacgagnganccacgggnggaccccngganccnngggnncncggagggnggnacaangaanngccnngcgactcncgcacgtcncanacngaggactcnggcacggcgnnngactcaanaggcgccnnaanggnncaccggcggcgacnanaggccgcgngcncagcgcncnngcncaaacgngngaacggagacgangacncgcnactcnngagnccnccgcngagcggcagggcnnggganacgncnanagncacagacggagcaanncaanggcgcgcgcgangacccaaancnacgangngcgcagnggggaggcgcnacnnnnncanncnaagccgcgcggncacgacagngcncgnagcgcgcgnnnnnagancagncacgcnngcncagcgccgcatcagcggcgcgcnaacacaccgcggnnagnancgcgagtcgcggnacnancccncnagnngnnngaccacagncnctccgccccacgcnncncgnatgcnccgaanacncacnnnngcnnccgngcagtcngcacgcggcgananccncgnctaacacacgcgcgncacacngcgnnccngnngcgcnncgngacgnngnnntacacncncacgcatcngacanngngancgagcntgcnancgcgnnaacanacacgnnccggggcanccacnangntcgagncgacnangagagacgngncgannngngcncancncgagctnngaccncangcgnncgaccgccgcacanncacggcngngcngaccgngcaganncacgnncnncgcagacagccagccngcncacngngcacaganggacacangcgacaccanccgtnnancacngnacaccgccacgtacgcngcnncnnnacgacnnggcgcgacagcncgacgngcccgacgacacgcgcacgggccaccgcatcgctncncct

SEQ ID NO: 2431 - DNA, 754 bp, Homo sapiens
  misc_feature (1)...(754): n = A,T,C or G
gnnnnnnttttgaacnccgnttcgattccgttgctgtcgcttttcctttttaaagaaggctgctaattggattttggtagttcttacctcaagaaaacttgaattatttgggggaaagtaggctcaaaagagaatatatctttcacattcacattcagaacccagcaacctggagtccaattttcagtattttaactacctcaataatgctatgaatgtaagatattgggatagagatcccaacttgaaacaacagccagtgcctgtggtaacttaatgtcttgtcaaatacttttattgattggtttatatgccattcttgttatagaagaatatgccttttaaaaaagcttattaataacactttcccaatttatattttaaaaagctaaagaacactggattaataatcttttgggagggtagaataaaataattgattactattgctgcatacccggggtgggatggggtggttggagaaccagaactatttttaaaacattaggtttcaatataaatacaactcacaactgctagctttggggggtgggggaacattgtgtgggttttgttttgtttaatttatggattagtctttaaagtaggctnttttttttttttgnaaantccggcccntttaaanggncncctgnaaaaaatttaatttntttnanggcttttccnannncccccttaaaaaaacccncttntaaggcccaanntggaaacccaaagtntttttggtttnccc

SEQ ID NO: 2432 - DNA, 762 bp, Homo sapiens
  misc_feature (1)...(762): n = A,T,C or G
nctcncccttttgnaacctcgnttcgantccgntgctgccgnanatnancagcccctatnacnnacgtagccacantcncaaatnncaaaagggaatgttctaaaactttttcttccttaaaaatggagaaaattgcacttgtgcttgctgngtggtatataaaccaggattagtcccagggtcgtgaggttcctggtgaaaaggttaaatcgtngaagctagtatattntntatatttttgnaacaatngcttttttcatgggggaggcggngttagtatttatagncctaacaagtccagtaattnnttataaatcttcagattataaacagcccctaaaaactttacaacgtttacacagttttttaaaaagagactgtntacacttgatttgctttcaaaataaatanngtcagctagtctangaggttaacgtcnggtaggaatgctgatcatgataggtttggttttctacagattctgttccggtgccntttcctatccaggcaccacctganaaagntgtcatttgaggtcncacttggaagttacatctgtgaagcccctgtcactcgtccagatctgtgttgtgtancatgtgcttgaggaagcacgtgctgggctgtgccctcatacagtgcatnaccggggcacccagaaggctngcctggctatcttctgtctcnggtnnngtgtggagtgntggngagggaacagatncnngatcaaacctggggctggttttcccgtctaggctcct

SEQ ID NO: 2433 - DNA, 746 bp, Homo sapiens
  misc_feature (1)...(746): n = A,T,C or G
nnnnnnnnnntttttaaacnccgattccaaattccgttggctgtcggtgaaacgctgtctctactaaaaatacaaaattagccgggtgtggtggtacacgcctgtaatcctaagtactcgggagactaaggcaggaaaatcgcttgaacccagaaggcggagtttgcagtgagcggagatcacaccactgcactccaccctaggcaacagagcgagactgtctcaaaaaaaaaaaanttancntntattttttagggcctttcnanataaaanggggattttcttttcctgtntaaaaatntaanctnctngttncattagtaanatngtnttgngngggttagtatatgtgnncttgnaacagtntcccnggntcctttatccnctaaatntcagtaggtncccnattntgnacactggttgngacanccaaaaaatgtntccanacnttggcaaatgtntcctgggggaacaaaatngctccnttttgaaaatcactgcnttaaatnctntgttnaggnttaaataagacncntaaaanttttaanctagcaggggactaanaatttgngagtattgtttgttgcattttcatatttatcatgttggaaatttaaatttnccctagccttatttggagagtttaactttttttttnggttngtttngttttgaactncatnttnaacccactgttaaatgttaagcccttaaagggaatttaagggaacattttgngncccccn

SEQ ID NO: 2434 - DNA, 757 bp, Homo sapiens
  misc_feature (1)...(757): n = A,T,C or G
nnnntnnttttttcnaanccccnnttncgaattccgttgctgtcgcttgtttttccacacagtggagctgtaactgcactaagatggagcaaacagatttccaaagattaagattcagtaaattatagtgagaattgacaagaagtttctgtttatccattgaccagagaagggaaataattcatcaagtttagtttgaaggtctcagggatgttgaaatcagacttttacatcttaatccagtgagaatgaaaaatgaactacttatagtgtctgcccatgacaagtcatttctttgcttanggatgcaaatcgtatcacacagtggtctgaaatattcctttcaaagagataagctgtttgtttttcaaaatggagcttccaggtgtgctaattctgaacacgaagctttgttatttggagaanaatatccttttatggtggtactaggttagttggcaaatatttactaatgcatactttgngctangaactgttgtgttcatgaggacagagaaaagacaacacagatgactccttgtctgtacatagctnccactttagtgggaggagacaaatgatcaaagtgcccccatgagaagatacgataaagtgatgcnttacagattgactaaattggttaangaanatctctcataagaggcccangcgccggcggctcacacctgtaatcccagcactttgggangccnaggcacatggatcatggangtcangagttcaaagatcagcctgn

SEQ ID NO: 2435 - DNA, 798 bp, Homo sapiens
  misc_feature (1)...(798): n = A,T,C or G
nngnnnttttttccaacctcgattcgaattccgttgctgtcgaaatattgttttaaaatgcatcagcctatgctatacaatctgaatgttattttaacttatagttttttttaatatatatatttaactataaggacagtttagggaacaagttacctaccacatttcactttagtgtacctatttacagaaagattaaactgccacctgcgggcacattcccataaatgtgtactttactttaaaaagaacatgccacgattttgtctttctgtggactcaacattcacttcgattaaaaatagcaatttgaccaagttggacttccactacaaagcagctgttttccaaagttcaatgctgacatatatgtatattaaaataattgcctatttattaatctacaaatagacaacgttggcatgttcttttctgtttgtctattaatgggcctgcttcttagcaatattagaatgttttataaaagcaattcatgttacttttctggtcttttcatggcatatgagcaaataataaactatttacactactaaaaaaaaaaaanatccaaactaaanntannntannaaaaaanaaaatntntnnccnggnctttnttntnnnncnnncnccncnntnnnnnancnncccccnnnnntnntntnnnnncccncccccnncttctntnacnnnnnntnnnnncnncnnnnnnnnnnncnnannnnnctnccttnctcncnnncnnnnncncnnntnnccnnnncnnnccnncnnnncnnnntnnnnnncnnnnntnct

SEQ ID NO: 2436 - DNA, 852 bp, Homo sapiens
  misc_feature (1)...(852): n = A,T,C or G
nngnctttctacangancgattcgtgctgtcgncaaaggctccactccagtnnctcgcctgtnaatcacnaatatgctnancaggagaggcttttgnantcatcttcatcttgacattncaagagcagnacngggtnagcatncacaaaagnacactgtaaaacngggaactgtgtnctacccttcctgagtnaaaagggaaagcttatgcctcagcctgaggcaggngggccccttgccatgcacacctttgtgctgcanccagggatccacttggctgggctcaacccttccccgtagggacgactgtacanaaaggagcncggatagnagcaaggcccgncanggngaangcctgcttnctgtgggtccccctgcgtggctggcagggagtggtcngngctnggagtccnnaattacctgangacacggaaagctncancttctntganaaaactcanattttgtaaattgcgccatccanttganagcacnttacngnggnaatcccgcggagattnggacttgntanganngccttngccctnancggnggtncttnnncctgtcgnntggtccctgtanntnggntgcctttgannnnnttgtntnttccccntagnntctctctttactncnaggnttcnttcanttctttcacngtanatnccgacanancntcctcttntggcactncnttanacggantcccttnnacganatncttatnnnnntctantgnctnngcnattnnttcttccttntcccntttttgccnnccnngananatcctnnaaaanncntctngctataaaccgttcttnncntatcncanatatntnatanctnnct

SEQ ID NO: 2437 - DNA, 750 bp, Homo sapiens
  misc_feature (1)...(750): n = A,T,C or G
nnnnnnntttttcaacctcgtttcgaattccgttgctgtcgcctgaacctgaaaatcccaggtgggcgtcggggactagtanggtggggaagccttggctccagccttcagggcagtgggtgcctttgggaaccaagtttaggcatggcccanaacacagtatccaagtcggctgtgctgaccttttcattncacttcatttcattatgttcttctatgtttattttcacagagtctcatccaagaaaaacaaatgtttaccttgctacctttntcctcttccaaatanaaatagctttattgtgtcacatgggggaaacgtagatntgcttttagattttcagattaactatctgtcaaatngaatcatgtcagtgaaagaactggccctgccgatgccagggtctggaagtatttaagaggtggcagcccatcggcatccttctagtatttctctntcattnctgaaattagaacnagggctgtgctgcanaactcgctgggccacatctagccctttggtggtgaatcgttcctctngggccccgattagccagtcaacaggtcacacagtctgctgaaatgtgttccaagttctttctatagagaatccttcccnagggaagccactgtgantganaattttgangctcctntgcccagaagtttggcatgttctgtggaaatncncaaattcttacatanaanggaaatctaaatcgcntcagatggagcttgtgttgcgagctc

SEQ ID NO: 2438 - DNA, 1233 bp, Homo sapiens
  misc_feature (1)...(1233): n = A,T,C or G
cnccnnnnnncctnccanntcnnncncnnnncnnncnnatcctcnatnnntnnncncnancntcnntacnnanncacnanannnnnccgnacnannntntcnnnntntacnncnnnncannactctcacacctnnacncncannccncncatnccntnctcanaacntncaannctacnnntcnccgtccncacancaancatcccacatncacncntctcatatnannctnagcngnantttttttaaccannccccgaattccgntncncnctcngcgcagtnggcacatactggtcnngccaagctncataaggnncaagtgggaggatcgcgtcaacacccagggagatgtgaggctgcagatgagctgtgatagngccantgcnctcancctgaatgacagagggacaccctgnnnnaaaaaaaaagtcagcggataactaggacaaactacnttttaactgctnanagctggtggctgcgcatantggacagaccnagagactnnaggctcaagagggcgtgtatcgtccacctctaatgngccaagggaaccttgccttaatantgcnnanngnntgaaanatggggnccnngnannncngccggggccacagaccaagactccatngcactaaacnnnncccgangcnagcnnnangacaaagggnnttaanaaagantnnacatcccaaaaccattggcggnagggccnngnnncnnnccgagcngacaaaaggcttnaangaccacgcggancactcnnatnngnngcanntggggntacaanaannnccgnccnannctangnttnaanaanngnactnnccacgcaactttttanaaangcncctcngacncnnaaacattngcnccctnanaaangncnnangccttnanatcaacgnncaagggcacnctntgcctnanagggngnaaatctntctcaggnnnccnntcnnagggcntannaacactcgggcctcggcaaacnnagnaancccannacatcgnntttngcccnggcgntncngcaanacacacccctngctngngggncacgcaacaggggnnnaaaccntctttggctgcantaannnaagcangccccnaagcaccctntcttactcncnaagatannggctcnanaaaagngnccccncgctccnnggnanantccnnatctatcntaccncanntcgntncaaacnaagccntnangnanancct

SEQ ID NO: 2439 - DNA, 784 bp, Homo sapiens
  misc_feature (1)...(784): n = A,T,C or G
nnntcctttttnaaccnctttcgaattccgttgctgtcgctcaagcttcaaacagcgcagataaatgcaggcaagtaaaagatgccgccgttgctgccgtcaccgcctcctgggtcgtccgccacgggttgcactgccgtggcagacagctggacttgagcagagggaacgacctgacttacttgcactgtgatcccccttgctccgcccactgtgaccttgaaccccatgcactgngacctccccccttctcccccttcccactgtgattggcacatcgacaagggctgtcccaagtcaatggaaagggaaagggtgggggttaggggaaggttggggggacccancaaggactcagagagtcagacagtgccacttggccacttggggtaaagccagtgccagcacttaacagnntatcatgctcattaatttgggatttnaaaacacaaatgaaaactcacacccacccacccncaagtgcatgtcttcatcacttaaaaaagtaagttcatttgaaaatattcctttctttttttctcccttcctattntngtttgattatccaaannntctgatctncncnaanaaacntcnttngnntggggntnttnagnggtttaanatgaattttnnacntnacacnaaaggcnnnntctngnnanntcttactttnnaannngtcttctngggcaaantctccttnaaaactcttaaccnntnngntttttgnnngagnnttaacntnntgccttccctanctgncncccanccttnaacnnct

SEQ ID NO: 2440 - DNA, 783 bp, Homo sapiens
  misc_feature (1)...(783): n = A,T,C or G
nncttnttgttcnancccgttcnantccttgctgtcggcaactcggaggagaagaccccggcccccaggctagctgcggagaaaaccaagaaggaggagtacatgaagaagctgcacatgcaggagcgtgctgtggaggaggtgaagctggccatcaagcccttctaccagaagagggaggtgaccaaggaggagtacaaggacatcctgcgcaaggccgtgcagaagatctgccacagcaagagtggagagatcaaccccgtgaaggtggccaacctggtgaaggcgtacgtggacaagtacaggcacatgcgcaggcacaagaaaccagaggccggggaggagccgnccacgcagggggccgagggctgaggccaggcaatcacgggctatgcccggggagctgtcgggagtggcgggaatcggggccatgcccggggagctgtcgggagtggcgggaatcggggccatgcccggtngagctgttcgggagtggcggnaaatggggggcatnaccatgcctgccgtcgggttcctgcgctgacacctggtcttgtgcacctgtgttgcttacagttnaaaactggacacttttgtattgtatattatanagacacctgtttccatttctaatttatcaaaaatgngattatcctttaaaaaannnctattnannaantttcttnggnggccntttttttncnnttatantccccnnnncantttattactaaacnccatnnntncaattttttggtccaaaactcctccnntctttagnnn

SEQ ID NO: 2441 - DNA, 751 bp, Homo sapiens
  misc_feature (1)...(751): n = A,T,C or G
ancnnnnnttntttnaaccccntttcgaattccttgctgtcgccttcagccccctgttcacagcatgcatttccccggattgctcccatccgagcagctgaatccctgcacagccaacccccacagcacctccagtgtcccctctaccggcctgactcgagcagctttgcagccagccttcgagagttggagaagtgtggttggtattgggggccaatgaattgggaagatgcagagatgaagctgaaagggaaaccagatggttctttcctggtacgagacagttctgatcctcgttacatcctgagcctcagtttccgatcacagggtatcacccaccacactagaatggagcactacagaggaaccttcagcctgtggtgtcatcccaagtttgaggaccgctgtcaatctgttgtagagtttattaagagagccattatgcactccaagaatggaaagtttctctatttcttaagatccagggttccaggactgccaccaactcctgtccagctgctctatccagtgtcccgattcagcaatgtcaaatccctccagcacctttgcagattccggatacgacagctcgtcaggatagatcacatcccagatctcccactgcctaaaacctcttgatctcttatatccgaaagttctactactatgatcctcaggaagaggtatacctgtcttctaaaggaagcgcagcttcattttcaaacagaancaagaggtggaaccctccacc

SEQ ID NO: 2442 - DNA, 746 bp, Homo sapiens
  misc_feature (1)...(746): n = A,T,C or G
nnagnnttttattcnanctcgtttcgaattccgtgctgtcgccgcgtccgccgattcctcctccttggtcgccgcgtccttggctggcgtcagaaaaatggctacaaacttcctagcacatgagaagatctggttcgacaagttcaaatatgacgacgcagaaaggagattctacgagcagatgaacgggcctgtggcaggtgcctcccgtcaggagaacggngccagcgtgatcctccgtgacattgcgagagccagagagaacatccagaaatccctggctggaagctcaggccccggggcctccagcggnaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggncccacagacccagcacgtatctnccatgcgccaagtggagcccccagccaaagaagccagccacaccagcngaggatgacgaggatgatgacattgacctgttttggcagtgacaatgaggaggangacaaggaggcggccagctgcgggaggagcggctacggcagttcgcggagaagaaggccaagaagcctgcactggtgggcaagtcctccatccttgctggatgtcnaagccttgggatgatgagacggacatngntcaacttggag

SEQ ID NO: 2443 - DNA, 732 bp, Homo sapiens
  misc_feature (1)...(732): n = A,T,C or G
anctcggttcgaattccgttgctggtgtttttaaaatacctggactcaatgacaaagaccgagtcttctttttttttaaacaaaaacaaaaaaagcaaccagggctatttgtacagttgaaggggtgaacagaatgggcggctgtgctgggagttggaagaccgggcagcccgctatttagagccatccctcagtcagctggcagggacaagccaacgccaggtagcatgtggccacccttgcccagtgtctgtggcctggcaagtggccacgccctgtgtcagaccatctgggaattaagctccagacagacttacagatgccttccttaggagttcttgcttcttgcgttgatactttgccccagaaaggcctgggattcattctggttcttatcagggtgtgtccacactctgctcacaggtggatccacggctttccagtgcggagagtcgagatgctccctgcagcccangccccgggcacctnctgcaaccatctctgggctcagcacctgaggcgggtttcctgggtcccctntccagcaagccttcaccagcaagctcggcccanancttcccttccggctggctctgaaccgtgcnttggtgcctacagcctgcatcttggagacaagctttttccggantgcttttgggagccaggccagggtgttaagggaggtgcaaaggcattccgggccgggagcaacccccaggtttgaacaggtgc

SEQ ID NO: 2444 - DNA, 859 bp, Homo sapiens
  misc_feature (1)...(859): n = A,T,C or G
anttganccattncgntgctgtcgganacctcacgccctanggatgtagccccgctcgcagtgcacacgcagtccgcacgccgncgacctctgagcgggtcagacgcccttgtgctttttgtttctagggacagagtccccaagtgggtgcacgtgttaatnggaaaggtgntcctggagctggagcgcttcctgccccagcccttcaccggcgagatccgcggcatgtgtgacttcatgaacntcagcctggcggactgccttctggtcaacctggcctacgagtcctccgtgttctgcaccagtattgtggctcaagactccagangccacatttaccatggtcggaatttggattatccttttgggaatgtcttacgcaagctgacagtggatgtgcaattcttaangaaatgggcagattgcattcacaggaactactttttattgnctattgtaggattatggactgggccagagcccacacaagtttacaagtttcttggtgatgaaacgagataaaggcttgttggtgggagaatgctntcgcttgcccctgtttcggagacaccatttcccgtcnagcttgctgatcccgngcttacccttganntgaagtcngnaaaccttccgaaaccancntgttnggcangtttgggcccaangaacttccccctttatttgnctggaangttaaatttaccnattngtttggntngggcncngttccccccccggnaaaggggggnttngggtcattcnaccgagggaaaccngaantattgnggcccnaacccanaccantttttgggcccnttttaaaaannccctttttgnaatnnggnaaccgtngggnntt

SEQ ID NO: 2445 - DNA, 796 bp, Homo sapiens
  misc_feature (1)...(796): n = A,T,C or G
ttnnaacttgaatcngcacaatttgaatcccaacctcagaattctaagtcccatatattagtttttggtaacaatcatcagtaaaggagaatattttaaaaacctataaaggagtccttgacaatactatctaaatctttttatacattgataattttataatataccctgtatatattaggtaaatgcctgtaggtctccaaagacctagaattgagaatcagagggtaaacatccaaacaaatcccctagatgtgggaaaataaggaagttatcttatttcgtcgtcatttatattgaggtgaatcatgatgganctggtatgagatttcctcaggaggtttcttgaagcttatcatgtttacagaccataacatactctttgctgattcatatagcaatgaatgataaaatcagaggcacttggtttgggcacttaaaggaatgttttcatctcttctcccagttgangccatgacttgaagaaaggttaaaangntttgagtatcaagtagcatcctacaaaaggatctaaaactagattttctagtttggctcacttaanatgataaaatgagataattggagactatcngttgtaaaatctgaagttnggaaatnacaccgtagccttgaanaaaatggtcagngattcaccaagaaaaantangnaaacaaccatttacttcaagtttttgccttcaaaaaaagttaaaanggattttttaaattggaanaaaaanctccctnaaattttgntccttntaagncctatggcncttttgaaaaaggaanc

SEQ ID NO: 2446 - DNA, 780 bp, Homo sapiens
  misc_feature (1)...(780): n = A,T,C or G
ttntactcgntcaattccttgctgtcgganaagttgagtggttgggacagtggtcccnttcgngntggnnagancactgncttagatnatgtgnggntcttctctggtcagaggcccaaatgagtggacaagtactgtgatttctcaagcccctatgcagtgttagatgccactatgaaatacgagccattgaaagagatctcttcaacttattattttttatcacgaacgtacatatcagttatttatgagatttttttttttaaatatttcattttttttcacgactttttctgccattgaattagcctttttctcatgcactggtggtcaagaaatacatgccataataagatggcagttaaacttcatcagtattttttttttttaaataagattttttanccnggcncaggggttcgcncctgtaatttgaaccttttgggaaggccaaggcaggaggatcacnttgaggccnggagttcaagaccagcctaggcaacttattgngaccttgtntttcagaaantganttccttggccatgggggcatntncctgnaggaanctgaagtgagaggatccttgagcccaggagttcaagaccagcctgggcaacntagtgagaccntgtcttttacagaaaaatttaaaaanttaactggggcncttggggccccgtgcctttttaggaagncttnaaattgggggaagggatcccnttggaaccccaggggagttttgaaaccttccantggggcccaaaattcnccncttcnnt

SEQ ID NO: 2447 - DNA, 806 bp, Homo sapiens
  misc_feature (1)...(806): n = A,T,C or G
tcgntcaattccgtgctgtcgcttgtttttcagacctcgaactatggagaacaggaattgaagcccaggtgggtgtccaatgccagaccatggatcatcagcctgggacaccaaagtgccacactctcagagtgaggatgatcctcaggaagtcagctctaccaccctccacaccaggaagtgcaagcagactcacctcatgattgagcagaataagagaatccttgagaagtcataagtttgcatggatttgcagcacaagttcaaacaactagatggcaccaaatccctcaatttatgaagacatttaacgtggtacccaattggaaacgcctcatggcagaaacaaacataaatcctttctagaaggttgccttgtccaagtgtttcccaaaccagtntttttagggaaaatgcncagctnactataacngaatnttaacctaaacttggaaatanggaaccagcananacaggtctgcanatatttcggatatnggaagnatcanacacagattttaaaacaactntncttaagatgcttanngaatnaaaaggcnacntttaaaanttatttnccccntngaaaattttttaaaaacaatccancatgtttggaaaagagaagcccaantggaaattttcctaaancannaccaaaccnaanccaaatggaantcaaattggaaattttaccaccancancaannccccnnaacacattggggaaaaattaaaattgccnttttgaaagaagagnaatttaagtngnaaccttgnaaangatttangggaanaagnaaaaa

SEQ ID NO: 2448 - DNA, 842 bp, Homo sapiens
  misc_feature (1)...(842): n = A,T,C or G
tacttcgntcgattccgttgctgtcgcttgtttttcagacctcgaactatgggagaacnaggaatttngaagcccaggtggggggtccantgccngnccttggntcntnancctgggccnccaaagggccacnntttcagagggnggntgntcntcaggaagtcagctntnccnccntccncnccaggaagngcangcngactcncctcatgatngancagaataagagantccttgagaagtcntaagtttgcntggntttgcagcacaagttcaaacaactagatggcaccaaatcctcantttatgaagacatttaacgtgggtacccatttggaaacgcctcatggcagaaaccaaccataaatcctttctagaaggttggccttgtnccaagtgttttcccaaaccaagtttttttttangggnaaaatgccccagctttacctattaaaaaaaaattttaaccctaaaccttgggaaaataaaggaacccaggcaggaaaacanggtcttgcaaaatantttcaagaatatttggnaagtatcaagacaccaggantttttaaaacaacctattctttaagnatgcttaaaggaaagtaaaaggcaagcttttaaaatttataggaccataggaaaantatttaaaacaattccagcatgtttgaaaggaagagcccaataggaatttnctaaaccaaccaaccaaccaatggaatcaattgaaatttacaccaacacacaccccacaatgggagattagatgccttttgagagagaattagtgactgaaagataagagagaagaagtccccgaacttacctattgcaaaaaaaaa

SEQ ID NO: 2449 - DNA, 813 bp, Homo sapiens
  misc_feature (1)...(813): n = A,T,C or G
nccnttcgantccgtgctgtcgctgattatccgaatgagtaagtagatttctcactttgtggatggtccgttacctgggatctcctatcctcctggggctgaactaggagagtggaaccagagtcataatgaggcatctgatgaggggaggggtagggagagagagaaagagacgtagagaggaggagagagagaaggatatctcagatctcattttaaggctaatttgagaggagacacgtagagtacttgagaacctgggtcctggcaccagacaacctggattcagatcctggctgtgccatttcctggttgtatgatgttgggcatgtaacttgacttctctgcctcagtttcctcatctgtaaaataggataatagttttacctcatagggttgctatgaaatgaagtaagtaatgtatatatagagtgattagaagtaaaaattcgaggctgggcggggtgactcaacacctataatcccagcactttgggagggcaaggcaagaggattaattgagcccaggaatttgcgaccagccttgggcaacatggtgaaaccccatctntacaaaaatncaaaaattanccggggttgttggtggccacattgcctgtaatcccagcttcttcaggaaggcttnaaggtccgggggaaggaatggctttgagccccaaggaanggtnggaaggttccaantggggtcccaagaatccancccttggggtggaacannaaaccnaaggnctnntggttccccccccatttcccccccnaaanaaaggggagnttaaaaaaatttgggancct

SEQ ID NO: 2450 - DNA, 765 bp, Homo sapiens
  misc_feature (1)...(765): n = A,T,C or G
tnnacatcgnttcgaattccgtgctgtcgccagaataagcctatcaaacataggtcaaatggttaaataaagaatgaaagcgtaaaagccatagaagaatttttctgttgtcttggagtagagagaccttcctaagtttgacacaaatcccagaagctataacataaaagactgatacatttgacaacatcaaaatgagatccacttcataagagtaacactgtanacaaagtcnanagatacatgataatctgagaaaaataatttggaaaaaatatgataaaaggagttaattttcttaatatacaaagagcccttaaaaataaataaaaagggtcattaattgaaaaatgggcaaaaggacatggatagaaattcacagaaaagaagtgtaagtggttcttaaatatatgaaaagacccacaaccctcttataataaaaagtacaaatcagagctgcaataagaaggcatttgtaacctatcagattggaagagatcaaaatatttaataatacactgatttggtgacagtgtaaagaaaaattactttcatacattgctggtgagagtaaatggatacgattgctttggaaggcaatttgtgatatttatctaaattatgaatgcccatctcttagaacccagcagttccactaatagggtatccggcctagagnaaccctcccatggtccaatgtcatttggccattattggaatccatgggaaaaattgaaggaccaccaatngtaaatntccctccgc

SEQ ID NO: 2451 - DNA, 834 bp, Homo sapiens
  misc_feature (1)...(834): n = A,T,C or G
cgntcgaattccgttgctgtcgggtttttaagaagtcgttaaacttaatatttactagaatatttgtttttggatggcatctaatatattaatagcccagaaaaaaggcgccactaatgaatatgtcttggattacatagtgacatatattagcttttcgtccacatttgataacattgctaatattttctttttttttactgaagctctttgaatttaaagttttctctcatttaaatttattaattaaaaacatacctttactctgttccctttagcatttcaacctgatgttaaaagatgtgtatgtgtgatatgtgtgtttgaaattttaactttcatcttggagtatttaattctctgaagcagtgcatgactcttgctcttcagcctcttgagagtgtcccctggtttatattcctgatgatacaaaccctggaatttctngctgaagtgttaacactttatttccaggncctaatttgatttgaatagtggaagttcagattcaatgccattaatgacagattctatgttgacttnttcagatttgccagaccngaaaaacctcctttatgtgaaggaaaatcanttangccttttttgnctaatcctcctntggtattaaatggagnacctcntttttcttcatttaagnattgaaggttnaaaaaaggaatcccagnaaggaatggatccancccaggttnttcccccccaagaaantttcctcatnnttaatttnannaatntnggnaaaaanggnaanacccnaaantcccttgggggnatttcccnttttccccttaaaaaaannggggttcgnatttncct

SEQ ID NO: 2452 - DNA, 745 bp, Homo sapiens
  misc_feature (1)...(745): n = A,T,C or G
cgtaaaagnaaaaatctcaagaaaacagaaatggcatgctttacccatcttacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataaaaaatgttggggggagttgatgaattcctgttaaaagctgttcttgtgtgttacatgtaacagacatggtaaatatttgtttacagtctttgtttaacaaaccatgcatttaagtttaagtgaagtcaacaaaaaggaaataggtgtatggatatgtgattttgagattaaagntagtcttaaaatgtaaataaaatgtgaaacgtgtcctcagagactgtgccatttctattatgttgatgtatatgtacagtaccttgccagggaagcaaaaattggaattattgtagcttttcatgtatacacacttttatttaccctattttgtgtacttcttgtgaattataatttgcagactatttcagaaaagaaattatctagtttaatttcttctttggacaaggagtcctaggtattatattttgagtttgatttcaccagaaataatantattaaaaagatctttgcattctgggcagtccttttaggattataggttgcaaattatccaaatatatatcccatttttaaagcata

SEQ ID NO: 2453 - DNA, 921 bp, Homo sapiens
  misc_feature (1)...(921): n = A,T,C or G
ttnncntnnnannccgtgnnngccgaatgcctgcaggtcgactctaaaggatcccctggagccgacgcctatnnncccnacggtgnnnngtannacaggcngtggccgtccattgcagcntcttaantgggcctcnnntnggnggatttnaaaaaaaaattccccacttgcccttttcgcctggccntttcnttgatnggtgggnggntaaaggttggtnnaanngantttgaaggnccggntttagggacctctgccattgggnttnctgnttgangngaccagnagtnncccnggttcnccntttngnccttctttacaaggtccnnaaagncttgncaaaccggaatccnttgcctttcctnnnntggaangtnttntattacctagggcctgcncttgagtaatnttatttttgccnnanccgctggcntttaaaataggggatccntctcaatttttttccctngggtatttgngggaaataaaaaaaancttttcnaagcctanaangganaggttggcaccanggaccncaatgtggcctggaattttggcagaangattcaagnatgcctggcgccgggaaaatcttgcatanaattttttnggttnancctaaacccttggaggganaagccnttggacccaattaattnggcaaccaattncccnttttttttcttttgtgtttgggaaattaaaaccngggggggaaggccnttttnggggaaaaangggccttttaaattggaatngggnaaaanggggttagancaaattctttttccnccttanggggggnggaaaaaggnaanggcaancccccttnnnangggaaattgggttttgcccttgggggtaacccccttncccaaaaataangtttttttttttaaaaaaaaggttttnaaattggga

SEQ ID NO: 2454 - DNA, 789 bp, Homo sapiens
  misc_feature (1)...(789): n = A,T,C or G
nnncttagacctntcgattccgtgctgtcgnnngtgtgnaanctacntgtggnacccntnncnaangtgtcccaacatttttttgacctnnnancncacaaacccggnctgntcattnttcaagtgtaaaggccatggnttggtgctcncaagcatgaaagcccttggggaanatggtgtccaactttgggtggggcccgtgggaggctgaacaaancctanccattggggagctgggtgaagtcagaacaggaggactgggtaggaaggagagacctntttcccttatagaatgactaancactgtgggaaatatgggtttcaaaaccaantcttgaaaatttataaacaccagtgtaancctatggagaaggttggtgggactcaaattcctggngacataggtactttcnccacctcatcttccttaatggaanggaaattcttnaccngatgataaaataaaaaaatattgggccnggtaggtaaaaaaagaaaaganggttcatgcattatgtaaaaattaccaaaaaggcttatcattgaaagtaaaaaataatgttttaaatccaaccacttcttcccatcactcccttatnctggagcaccccctgtcccttncaaacatctttgacttttttttttttgngacanaaatnttanctctnccccaaggctnggaattncactggggggagantttnaananctactggaaacccnccncctcccngggttcaagccgaattttccntnccnnaaccntcccnnntagctngggacnnancn

SEQ ID NO: 2455 - DNA, 1209 bp, Homo sapiens
  misc_feature (1)...(1209): n = A,T,C or G
ccccccacganccgaannangnnannnacnnngaggggngnggnannnggggnnggnncgnnngnnggacgnnncnnnnnnnnnnnnnnnnnnnnantgtcgtngnacctttngggaaacccccnnnnnnnnggcngncnnggnnacncgnctgggggggnggcggangcgnggggntttggccccttttttttctgaganggcnncgagcggnnnccgggngggggganngnnngggngcnggacnngcncntntnnnggcnncnncgnnagaggnnnngggnnggggccnacanagagnnngancggnngcngggngcncangnaggggnggggagnnggagnncgtggatggtggtgncngcgngngagcgggnncggncnngcnangatntgcgntgaccgccntagnangngggnngnnnnctaaacagcgtngtangtaanataggnggggggggcagnaatacncggaggaaggngnagggngaggcnggancgggggngnggcggcagaacctcggncggncngnnnncgnagnnagcnggncctcgagtgtnagggnnangggggcggggnanaggggccancaagggggcannnggaagncgnncangggnngnnctnggcggnngaacccgngggggcggtggngggaanaannaaatgnggngaagcccgagggnggtgnntaanngaacngggggnnggggggacgannacgggggggganggggcncatagggagcacggtacagggagnancngntcaagnnnagngnngtngngcgccgggagnagcgaggngggaggcncgngggcggngganagagccncnggaccgaagaccgggggaaggggcannaagggnggngnangganataggccnancganccacnggggaccccagngggnagannacagaggtagnacgntangggggngcaacggagcanctnaggagccccnaggncggcgcagggtgtcangggaggncncaacgtnagagcgngggnacgnnggggnggnncgnncanngtgnnnaacggnnggnnaggaggacgggggggncggtnnnangngncnacagaggcagggngngaagcacnnngtacatnacggatganngatgggncngaggggnnggngnngggacnnccgntgnnggganacgaaggctcggaggcncnncnacaccgggggccg

SEQ ID NO: 2456 - DNA, 784 bp, Homo sapiens
  misc_feature (1)...(784): n = A,T,C or G
nntccttngaccttnngaagncgcatggttaggaagaactgttccacntacacntgacnttggagtcagttaatngatntntttggagatnggcctttcaacagttttcatatttgaagaattanaaatgaagtccgttcanattntccaaagaacctccagccactggngggggacattnttaattnanattcctatcanttggtntntcctgtccctgaaaacactgatgaggnttgggagganaatcccacctttccctgcagggggttaggctgggcagggcagggaggtgagggcgnctggtccaaaacactggcaagggatgggaacctaacttcttnttgtgcttctgatttgcccttgcaggtgtttttccaggtctgaccacctggcccttgccatgaagaggcacctctgagggacagaaaaggtggatcctgtangctaaaaggctttcaggctganagccgcccgtggaangagggatgcgtgttccagccaaagcatgccgttcttgcacccttacccaagttgccttccagggcctctccttggaangtctttttgangggctaaaaaaggtcttgttagaanccggcnatancaccccgtggtgcatgggtattgtgggtgaccctggactcgccactggntaccccgcccnttcngaagcggngccctaacccttttgncgtggagccttccncacttgagaaatgcttaatgggttggggttngaattggtattgttgaaggaatcttattacttgacccgaatgat

SEQ ID NO: 2457 - DNA, 1538 bp, Homo sapiens
  misc_feature (1)...(1538): n = A,T,C or G
ccccggcggganngnangngcgnngnnanngngnaannnngnaggnnngnannnngnnagaggagnnnganngcgnngcgnnggnngnnnganngagggnggaagaggnngaannannanngnnnnnnnnnnnntgtgnntaaacccttgggaaancccnnnnnnnnnnaananagagcccggagngcgngannagannnngggganggggggannnnacnnantttttttnnnngcanngcnnggaggggganangnggaggantcgnggaggggnngggngcagatgntntgnagngggganagaggaggnnagnngaggggaggangcngggagnaatgaggnggggnangnggnggncnngcccagganngggggngggggganacgngggngannnacgnngganganggggcaggaannggangacgngacggcnnacggacgnngaagggggggnccncgaagcacgngngggagcgncngagangngtgcgnagnggancgnngaagagangggacngaggnggngaagngagggggnngnnnnnagngnggganaggacanngacnnagggagggnggatnatnacgnnnnagcgcanagacgaagnganacgcgngggnanaggangcncngngagggggngnggnaaangngacgnanacgggacgggnnccgnagngngngaganngnaggnnggaggaaagggannnggcgggggaggggaaggggggggnganggggnanggnaangggggaggggggggnganngggangggnaanggnangaaagnagcnaggggagggnaanaangggancaagggcnnaggnaangganggngaanngntnggnacgngngaancaagagcnannnggagggacaagccacgggaagaggaanggncgggaagngnggggcgnanggnaagngtnngcgannnnancngaggcaggggtcgcgnnggngngngngacggggtnngaagnagacggnnganacgngggnacgntganggnaanggtacgggngancggaggcgagngnaggggangcnagggangggngacgnnangagancgctcgatcgntgaanggcngggaagagnggggcgggtnaggganggngangcnacgcanggggaacggnannggnngngatagnanagggnacgcgangnnggggcgcanacggnacncgnangcggacgngganggaaggggggagggangngnncgngcgggtnagccgcnngngcgnangnnggggngnggaagcgggangcgatngggatgggcacgtacgggaaggggggaganacgngaangnanggnggagggngcgggangganggggacgngaagngaagcgacggcnggganagncntggncgcgaagngcgggaagnngcggatccnngaangncacggncnnngcnnagcncgnagnacgannaaggcngtgtgtangnncacacggnngncncggnccacgggaccgcnaaggnaccgagggacgcgantgnnccg

SEQ ID NO: 2458 - DNA, 786 bp, Homo sapiens
  misc_feature (1)...(786): n = A,T,C or G
cantttannccctttcgaagccnttgctgangancctccnactcatatcattgtccctatataactgagngtcancagagntntnaggttnggccttngggatnaccttcattttccagggtctggccctntgcncttcanccanagnncaacctnntgttancagctgctactaagtctntatgcccattcgttnatnccacaaaacaggcntctgactcctctggncaccatggaacaaggcactngnaanaggcngggggtccacaggcncagggggcttcactctggaacaggatanctggggtgcagcgggatgtantcctcacttaatcaacccacaccccancntcccctgagctttctctaaatctcattctaccccatcttgactcttcggttaaaagggagttctcatttggagaatttgtctctgggattaatgaagtgtatgcctagctactttctccagttacttttagaccatattgttgtttggttttgaatatcattccttangctatgttgagaagtagagtggcttccattaggagaactaaatttagggcatgtcttttgctgaatcccgtcagcatatttaacaaaattcccaattctanannaattttcccntttatntctcttaagtacccttttgccangggcttctaccacatcaaaaggnggttcatgnaagtaatttggccaaaaggaaaagaacnagttaattgaccacctaacaccataaatggaagtggattaagttantggttccaaggccattgg

SEQ ID NO: 2459 - DNA, 746 bp, Homo sapiens
  misc_feature (1)...(746): n = A,T,C or G
tactcgntcgantccgtgctgcgcaaatctttgcccttctaaagcccaaaaattactattccggatcatagatngtttactgctgccacatgcagtnttncagcaagagangganctgcctgcacctatgttgtcagcaattcanaaaagtcttcctttgtatctccagggcatgtgtatcgggtgttgtcaatctcaaaatccgaatgcctatttgaatcaattgctagggaatgttattgagcagtatattgggcgatttcttccagcttcaccatatgtttcagatcttggacaacatcctgttttgctggcattgagaaacacagccactattccaccaatatcatctctaaagaaatgcattgtgcaagtcataaggaaatcctaccttgagtataaggggtcctcacctcctctcgcttagcatccattctggccttcatcctccaactcttcaaggaaactaacacagacatttatgaagttgaactactcctccctggcattttaaaatgcttggtgttagtcagtgaaccacaagttaaaangctggccacagagaacctgcaatacatggtaaaagcctgccaagtggggtcagaagaanaaccttnctccagctgacttctgtgtttangcagtttatncaggattatngnatgaggtctattaccagggttacagcattttaaaaacagtagccacattggancnacaggtggncatccacttgattctancct

SEQ ID NO: 2460 - DNA, 781 bp, Homo sapiens
  misc_feature (1)...(781): n = A,T,C or G
nnnnnttgaccttccngctgncggctctacgatggagtcaaggccagattgggctctatttccacaaccccctanggagtttttnaccnttgtcctaagnggctgtttcctgggngancntagancatatttgctgtcncnctgggantnccaggganaatctnatgcttggncagaggacatgatcatctttntgtttgtaacctcgggcctggaacagtctccttttgtgttcacttgattctgaaaggtcagtgttttanaacaggcttttcacatggttcaccaggaggccagttagatcctgtagtggaaagggcaaactcatggcancccttctgctttctcaaggcaggatgcttgcaaggggcagtgaggtaagaccggtggacaccgtgganggagaacaaaanggggagccccaggggcatctgcagccangtggacccgttcagccttctggcacacatctgtttggcttgggtgggangtatgaagggcgcanatctgaaaaccaagtggtgacctagggagggaacaagcgctgtgcagcattgatgaaacttaaaagatgaagtcctggtcccnggcaccggtggctcacttctgtaattccaacactttgggaagncnangcangaaanatngcttcaacccccgaccaaaaaaaaaaacccaaaantttanccggggccgnggngacattgtncctttagtcttaanttactcngggaggcttgaggttngggaaaanaattttnanccttggganggcaaagcn

SEQ ID NO: 2461 - DNA, 753 bp, Homo sapiens
  misc_feature (1)...(753): n = A,T,C or G
tctctncganttccgtgctgtcggnctttggttgctgttctttcctagactcttcagaaaaaaaggaattacctnncanngcttaaagaggtngtaaatccaanccaatccattttcattccanctgcntttcatgcttcaaagtaanggctgttanccagaatcactngtgaagctttatccncatatncattctgtgatcttattccctgtaaacccctattcantagtcggnctgtgatgaaatcccaggcntcttcnttcaggttaaaaaaaatntntntntgtctncntgaaattctggtattccctgttgaaaaccagtcttaagttanaggcattctgcagttgtncggaaagtaagggaaacaaagttaaaatggaaaaaattgaattaagaggcagaagtaatgaatttgatcatttgtcattgccnctcattgtagacacttatttttgatctctgtaaacatcagcttattctcaaagtatgangnctgaatacttgcttgngggtgatcatctttgtgtagaatagaaaagacaaagtaggaccnggtgcagtagctcacacctgtaatacccggcnctttcgagangcccnaggnggtagaaatgcttgagcccaggaatcaagaacagccctggncaacatggngagaccctgtctcttctggaaaaaaaaaannnnnnnnnnnnnnnaaattccnggggcccntttntcnggnntnccccnctttaaaaaanccttgg

SEQ ID NO: 2462 - DNA, 747 bp, Homo sapiens
  misc_feature (1)...(747): n = A,T,C or G
atgtcnttcgnatccgtgctgtcgtcctcctttatgagaaaagaaatagaccctgatagatgaagctataaagttctataacatntcttcattgaacgtgtgattttttttaaagtntaaatagcntattcatatttttgcaaattgcttgttttcagtacncagcgttttgagagctgtgtatgttaatgcagttgactcccgaacagngggtttgaattgctcaggcccacttatacctagcttttattcaaccaaacacataatggccagcatatatgaggagctaacttttcatatgtgtggtctccacagggccgactgcaggacttgagtatgcatggatttggttatatgtgggtggtcctagactagtctcctatgtgtgccaagggacagctgtacatgtgggcctaatcctttccttttaaaaatttatttgagatatcatcattcatataccatgcaattcatcttcagtggttttaaaatatttaccaagttgtggcccggcatggtggcttatgcctgtaatcccagcactttgggangccgaggcgggcagatcacgaagtcaggagatcgagangcgcctgtagtcccagctactcnggangctaaggcagganaatggcgtgaacctgggangtggagcttgcantgangcganaatgtaccactgccttcanctgggcgacagaacaagactcatctcaaaaaaaaaaaaaatngccagccttgnggctt

SEQ ID NO: 2463 - DNA, 732 bp, Homo sapiens
  misc_feature (1)...(732): n = A,T,C or G
ttntgacgcnttcgtgctgtcggcctnatccctntagacaggactacaattggcagctnccnattacctgnatgtggangganactttttttactntgcgtgttctggcntnagcgtgcatctggngccttgcacntgatgctcacatncctnaccctnnctnnggngtcaaacaatgtactttncagggtgnnantnntctccatnnctattngaagtggctngaaaaangcnannttgactcttntgacgttggatnnaancnncnaatnanccctcgagtnnttcaatgatanctgacnaactaaattatttccctataaangaanatgacatgagtgntgtgtggtttgnctanacnactgcatttacagctttttcagggntantcgnagcactgnacgttcagatgcatnccaantggtgcatgggtcctaatcacacatataaagctggntaccanctttggcncagcactgtnatctggncaancaactgtggtaannacacatgtaanatgcnttttnacagctgatactgtttcagacaaacccttnatgcaaaatttggctttagattggcnctttttgaanatatgcnacaaatatgngatgngatgccgganggncgttttgtcttaatgggaaantttaantccttgtgacacttacaggttctttgagacatgacttngnaaggatgggcctatttctcctntgaatgtcatagnag

SEQ ID NO: 2464 - DNA, 821 bp, Homo sapiens
  misc_feature (1)...(821): n = A,T,C or G
tatnttacgcnttngtgctgtcggggggatcaggatactcctgctcacagacacccatctccccctaccaaaaataacgctgggctcctcnttccaccctgactntgcctntntgtntgcaggancctggtcggggngctccacaaaagctgngcctgggctngggagccaaggccatgtccntttcccggccagggnanacggancccntccacagtgtcagntatggccatgtggccgcctgccagctaatgggcccccacaccntggccttgagggtgggananagccagntcctcctgcaaagcccccaggtggaaaaaatnatgcagctggtgaatgcctacttggccaacccctcccccgagaggccctgcagaagnttttttcctccatgccaagacctgccagacacctcccntccaagccagcgcccggcctggacnagcccaaggacaagtctggctgnttggggcaacttgcaggactgagcctgccaagaggtcacgacttccttcttgncttcagcctgggccangactgctctgagatttganggaaacatggaccctttttggnccttgcaggggacangggcacattccaacaacccnaaggcttacnaatnggggtgtggggtaaatttttctaagtttggtttccttnaaatttaatttggnaagaaagaaaaaacccaaaaaaaaaaaaaaaagnttttttttttttttncccccaaaaaaaaaaaaaaaaaaaaaaaaaaatttttttgggggggccggntttttttttcngggnnaaancccccaaaaccttttaanaat

SEQ ID NO: 2465 - DNA, 921 bp, Homo sapiens
  misc_feature (1)...(921): n = A,T,C or G
ttancnaacccctttccaagccgggggcncgatcttaaggacagtcgctccctgaacgcggagccggaggagacgaagggaaggtggnttngacgccacccgcgcaccgggcaggcgcggagaccggcgtgggacagccacctggngcgcagctgccagaaagaaggactttgctgctttgggccaggatctgaacttaggtgtaaaccattgccctnggcagaagggaacctaccccagtccattgctggcctgctacaagaatattgaaacagtaatgggcacaatatttttgggttattgaattcactcaagtgggactggtgggaattggaaatggaaactggtattcccattcccccaatcaatgaatggtancaagaaaacccaaggtcttcttttcaacttaaatngggaagttcttcaacttcttggttggcccccaaggccttgggaagtggccaaatggggtgccaaaatcnttngggcttttactgggnaacccttnccaccttaccattgtttcaaagncaaattcttccttggccttcaagccctccccgaagtaggttngggnacttacangcaccgttgcccaccattgcccaacttaaatttttggnattttttaattaanaaacnggggtttcncccatattggncaggcttggtctcaaactccctggaccctttatgnatccctncccaccttgggccttccaanggggctngggaattacaaggcgttaaaccaacccggttcccaaacccctggggnttaatggaatttcctaaaaacacctttttaaaatcaatttcttaaaaaaaaattttntnanggnggtttggtanaaaaatttaaaagggnaaaaaaatccctcnannaaatannttttggnancattcattaaaaattggcct

SEQ ID NO: 2466 - DNA, 773 bp, Homo sapiens
  misc_feature (1)...(773): n = A,T,C or G
ntactntttaccaccctttgctntccgttctcatggctatggctaaagtgtaagagggtaagcctccttgtacaagctcatgtaagattcttgcttatgtccgtgnactactcacatctcaattggccaaaacaatgcccaaatttgccaaagtccatggatgggagggattgcaatgttatattgaaaaaacttgatcatagaagggggggagattggaccagtcattcacctccccatatcttgccagccattaatatgaatacatattctatttgatattaattgttatctcctgctcatgagacagggcttgctccctgttacttctttcctcantgtctgtctgagtgttgcctgtcctggaattatanatatcatttgaagtattggttggataataaagaatgaatgagcccggcatggggtgcatgcctgtgatcccacacttttggaaggccaaaanggtggattgctttaactcaagggttcgaaaccactggcaanggggtgaaacccccatcttgcaaaaaagcccattattaacccgacctggnggngcatgccnggnggnccctggctaccncaaggaagctttaaggtngggaanggttcatttttgggncccccgggacaanttgaaggctttaaaattgnaattcttttaanccatgncccatttggcccttccaanccntngggtnaaaaangggggnggagaacttntttttttnaaaaannaaaaaaaaaannnnnnnnnttnttcnnncgcn

SEQ ID NO: 2467 - DNA, 644 bp, Homo sapiens
  misc_feature (1)...(644): n = A,T,C or G
ttactantgaacnccttttctnananacgtgactcgggttcctctagaaaanncagtgggcngantnaaattccaaaggcanngggganctggaggaaggccttaaccagggncggcggcttggtaaggtttgtaggaggactggntgcancaaaggcaggganaccagtgtggagtntgntcancaccccactgggaaggtggtgatcgccgtggtgatnancagttnttggtanctgcntgtgaggagggtgacaggtcaggactttacctcaggaaaccctgtggatggtggaggggaaaatcanctggttttggtccgggtncttttgagcanctgtgaagacctccaggacagtcccaatcctggaatgtcttgactaaccagatgcttanacttgggtctttctcaaccgtcttgggtacaatctgactctccactttcttggcctcctggctttanttgcttattggaaatgggcattttatcagcagncgtgatggatactatggtcangactgtacccactntnctcttaatatcaaacaaaaagtattaccaggactttatatgctactgctgggtntatccaccatcataagtaatgaaatnttactagattaacactgcactagaacctttt

SEQ ID NO: 2468 - DNA, 1127 bp, Homo sapiens
  misc_feature (1)...(1127): n = A,T,C or G
ccccccccccccnnnnnnnnnnnnnnngnnnnnnnnnnnnnnnnnnnnnnnngcgttntgnctcgagcgnggcgngcngcntttcnntgnnnggggggggggggggttttttntttttcccgnnggngnngngggggnggggggggggcncgcggggcgntttnttnggtggnggcggggncgnngngccgccggggncnccgccgggngtgncnggngncgcgngcgcggncnccgggggggngnnnnnnngggcngngnggnnncgnngnngnnnnnncgnnnngggggnggngngcgggngnncgnnnncnccgnnnngncgngggnnngggnncnnnngnnggcggggnnnggggggggnncccngggggggngnnnngcnnnnncggnggggggngggnnnnncgcggnncncgnnngggggnnccncngnngtnnnngnngnngncngnncgcggggggcngngngnggnccnngngnncgggcggccgncggcngnnnngncgngccgnctcnngccgtngnccccggnnggnggnggcngcggggggngggccncnccnngtcncgnngggggcngnggggggggnnnnggcnggngngccgngnnnccggngncgggggnggnggggngcggccccccgggncnggggcgggcggncnnggggcgcgtggtgggnggcggngngnngccgcgngnngnggggcggggcggncnnngnggngcgcgnggntgnggcggggncnngnngngggcgcncgnggggggacnggncnggcgnggcgggngcngggnncngcacngnggngggncngggggggcgcnngnggggnggccgtgggccnctncgggngccnngcngcngnggggggcncccncngggntggnggggggctgggcgggncnnnccccggncncgncnnngncgccgccgnnggcnnngngnggngcgcgggtnccgcgnggtggggnntgngnngcngccgnngggccccgggnngcgtcggnnggnngnncngttcgcgggggcggnggngngcgncggcntgggnnnggggngggngcntgcncgncgngnctggnngncgggtgntggccggcnnggcgcnggggccggtcccg

SEQ ID NO: 2469 - DNA, 1109 bp, Homo sapiens
  misc_feature (1)...(1109): n = A,T,C or G
nacctatcgacgttctcagcngnagccaaaacgtcgactctagaggatcccaaggntccgggtnggncctccccccggntttttctcttttactggganacatgagancnaacanggganatagggncnntgggtccatagccaatngnatncaatgtgggtgcccccatcctccnngnngntagtcttntcnccananaggaacccganccagcttggggnnannttttggctctcctacacgctngtcgtnnnttttancctcngngcntgaagggaaagtantgatggangaactngtgngcatgataacaaagntgcangaaaaatcatnngccntactgtccncttgantgtaacaancntcnttnttacntgtcnanantncacccnggaatggncntngnccctntgcgtantgtgggnnnanttncaaaaccccngntncntancttactnncantantngccccacctggatnnngcatagggtttggnngaagacctnnaccnnataattgtnnacnactgnaaaaantggtgaccantcgntcctnggccnnaccctaactaanacntctactatncttcgnanaaaaanncntncttttntattangnnttntagatnntatgaacctncncccttggntagnctntnacntaaataantntattgtgccangcnccntncngntgnaangccantnanantanaaaaccantgtctnaantcagagacacnattttgngcccnnngctgaagnaaanaanncttnattngntttcacnnggatantagttntttttataataanaccncnagaancttntntgcctaatttaacntntactntnanataaangnnntacaccgntatnancttgnganatataaaannacaancnntggnatntatnctnancnccctagctcataaaacnctanntancgntgnggatnatantanaacnngnggctctcnccntanattggaaaaaccantggtnangcttttggaantcttatttatagtnncgtacgnanatgtntaccnnatgncncttnncnaaaanaactatagtnncttcntcttnntnganatnang

SEQ ID NO: 2470 - DNA, 782 bp, Homo sapiens
  misc_feature (1)...(782): n = A,T,C or G
tattttaacncctttcganttccgttgctgtcggatagggcaatccaagagacatagtcctaaccccagagtagcatgtaatcccttcttagcatccctctttgaaaactgaagatagtacagctgagggaactgaacaggttcccaggatcatagagaatcattaagctgaagcaaacaaacaaacaaacaaaaggcaaactagaagaaaagcaggattcaatgggttctgcaccttcttagtctatcattgctttgtaaacattctccggttttacattactacagaatatggtccagatataaagttctactgtgtcataagacagctgattttcagaattcgtgactgacagaaaaaacaattttggatttaactggatacagtaatctgaggacaactgcagttgtcaaccttttcttcctttcattcaatgataaaagatncaaaaagtgcaccagatgtttctagctatttgtggaatgaaggacatataaataattttttttttttttaaatanacagattntcactnttgtcncccaggctggactgcagnggcacaatcttggctcactgnaacactnttgccttccaggttcaanaaaattnttgngccttancctncccgagccagctnggggagtacanacccctggncccccataccccgggttaattttttggggccnaaaatacccncattnggccnggcccacctttttatttaanaaaanattggggggcaacctnttgctttaaggacctcttgggatttttn

SEQ ID NO: 2471 - DNA, 748 bp, Homo sapiens
  misc_feature (1)...(748): n = A,T,C or G
ntnnnttaccancgntcgantccgttgctgtcgataactttttactcatatcattgtccctatattagtattaagagcattttgtataaaacttcatgtgaggatctcaattctttataattctcttcaaagcaaggaagtatatatagagagacctttattttttagtaattttttcaaatggtttgggagatcttattctagcccaattctattctggcacttaattattttctggtggcttgtaatatggtaaatactggattccagattgcattcctatttccttgggaggtgaggatactcccatttgtacaagaacttaaaacagcccaaaattattggtttactttgatctgataagttttgattgtggtgatgtctcttaataccgaatggggctacaattttaggtctgtgaaattataaatatcagcattctgactaagtatccagaggcagatgaacttttaggatcataattttcctgtgctatatggattttaatttttccctagtcttcactttctgttcagtaattttatagccctttggaagagctttatttgagaggctgtgtcttatgttgaaactgtcttcatcgtgcaaatatgacccngtttnctgtggagtcttcataggtgactatgacaagtacctttnccatcaancaccttctcaatgnccgaanaactgtagcatcagcttatgtggttgctaccccctggnctttaattccatatttccg

SEQ ID NO: 2472 - DNA, 748 bp, Homo sapiens
  misc_feature (1)...(748): n = A,T,C or G
tgacntancccttccgaatccgttgctgtcgaaggttgcgtagctaataagtggcagaactgacatgcaaaaccagtctgtntgccccnnnagatgcatgttctttaccatcacgtaggtcaggccaggatgtcaaggagagcaaccccgaactagtcctggtgatttagactagagcgtctttcactgctgtgattccttcattggcactttcttccagttgtacaagtgtctgtctttgcttggtctttgcttgttctacccttagtttagcagatatccctctctccatgaacaaggtgagtgagctctttttctgagtacatttggtttttcaaaatccctccaaggaatcatttccttgaccaaatgccctcatctgtggtggcgatcaacatctttgattttacccttttttttttttttaaanttgaaacaaantctccctttntttttnaggctggagtgcagnggggcaatnttggctcantgnacctccncctccagggttaaagnaattttcctgcctcancctccctaaaagcngggactacaggngcctgcccccacacccagctaattttttgttttttaaaaaanaaaaaagngggtttccccattgttaaccaggntgggttaatcncctgacctngggatntgccccccttgncncccaaaagggctgggatnanaggngggggccaccatgcccggncaatttnccctttttttaanggccggnccngct

SEQ ID NO: 2473 - DNA, 1198 bp, Homo sapiens
  misc_feature (1)...(1198): n = A,T,C or G
nnnggnagnnntannnttatncgcgannnngnnnnagancgngnnnngnnnnnntggnannnnagngnnnnnnanggnnnnnnggcnnggnntgggnannnnnacgngnngngtgngctcgggaggngannnngcancgcggngntggtnagangatggtannnnnnnnangcaannnctnnnnnnnnnnnnntagannttngccctttggngaaagncgnnncaacntaggagnaanngnacanngaccccgntgganggctncgggngacgnaggggngctttttttntttttctncggagnanccncngggggggntggagcagngnnangnnctcgnnagnttggatnngannnnggngngngaccggangggtnaggngntgnnanncgntganntgtgnnnctnacaagggagnngagnanaggnngngnncacgacacnnnnnngngagnnnnggnnnnnangnganangcnggncgcggggaccnngnngagncngcngagnngatagaagantgcngnnaagnnntggngnccgngnggnnacgcgnngggnaaggcgnnggnggngcgcgnntngtggggagtagnaanccgagatnngnncgacngcnancncnannggaatgngcagngnggtggnnaggcgagtgcaggcnncggannntacggggnnngggngcacgccacgacgagannatngccangncgaacaggaactngtnnannncngngacgnngaagcgnnagtaganngnggnggnnnatnnggnntgnnnagnnnggaggngcgcngtggcangatngnnacngncgnacncgggatggggntgtngtggncctcgaagancgcgagngngnggtnagnnganntngacgcgnngagnngcnntnncggagnangngcagcncggacnnccncgcnaggacnntngatcgntcncnnggnngaangcgnngaaggcncncgantntganaggcganangnncnggatggnnnnnaaccgtgccggnngggnagggangnnagtagngacgnnaaaggaanggngagganannacgagagcgaatgngaatgnnctggtngatgaggggnagggagngnannngnggacgagtgntntggngacgcgcaagctgnnngacnncagagggganngntngggccaatncgcgnngcagcgtgangcc

SEQ ID NO: 2474 - DNA, 767 bp, Homo sapiens
  misc_feature (1)...(767): n = A,T,C or G
ttctgaccctttgcgaagccgntgctgtcgaaagaccacaagtttcagagcatggagacattcctgctgaatcgccttctcacctcctnngcaattgctcattctagggttgggcatcatagttggtcagtcttaattcccatgccaaaggacaaacaggtgtgacatttggatagatgaatactgggattggctctggagcatgtgttttgagttgaaccttgcagtcctttctctacgcccgtggattttgtggaaacactttgcaatctctttgctttttttttttaccagaactagttacattggaatgcttactgtcctacanagtggcagcaaataaaaccttgcnttccatcaagccaaaanagcacactctgttagagganatacatgtttaagatagaattggngggaaggacaaaaacagaaaaatgtttggcttttaanccattgggtagtattgttttgatgatcttanaggagggaanaanaaaagaaaagacccaatgntagaaccagaatcagggagatgactgacctactgaaaaacaggtcccttgtntttangatctttaangggtataaaaagcaaacatgacttttgcncctaanaaaaattctgcatttctcatagttggggcccaattaaccaaaaaagttgttttttaaaaaaaaatactggtcccattctaaaccatgattttttgggggaaactaatttttttccccnttttgccaaaaaccagtcctttccaaaattanct

SEQ ID NO: 2475 - DNA, 1000 bp, Homo sapiens
  misc_feature (1)...(1000): n = A,T,C or G
ngnnnnnggngnggggnnnnnnngnnnnnnngngggnngnnnnnnngnnggngggggnggngnnnngggngnnngnnngggnnnnnggngngnnngnnngnnngnnnnnnnnnnnnnnnnnnnnnnnatnttnnngcncttgggaagncgnggggnnnnnnnggngggnngggngngnntnggnnnngggggggggggggggctgtttgnntgttttnctcnnnnnngnggngggggggaggggncnngcngngtnncnnnttcncnggngtcggggggccgnngngggnnggggngggggggnggggngggggggggngggggggcagnggggngggcgngngnngngnnnggnanggggggggnggggggngnggngggggnnngnngggggggggaggnnnngnggnggnggggggnggggggngcnnggnggggggngggggggnngggngnggaggcgngggggncgnngggngnnaggncgcngggggnngggnggnggcgngggggngnnggggngggggnggngnggggnggngggngggggngnnggngngncgngnggggngnggnggngngggngnngnggncggngaggangggnggnggngnnggngggnngnnggggnggggggggggggggangnnagggngggngggngnnggcgangggnggggggggngngccgggggggggggggggngnncnggnggngncggnggggggganggggggggggngnggnggggggnncgggngaggnggggggangggngncccgnnggggggggggggnaggggcnggggggngggggncnncgggcggnccccgggggnnnnnnnggggggngggnnggcggggggnnncnggggnnngggggggggggnncggggggggggggccggggnggggnngnnggcnggagnnntnnggggngcnnngggggnngncggggnganancggggnnggnnngggggngcgcgtggnngnnngc

SEQ ID NO: 2476 - DNA, 882 bp, Homo sapiens
  misc_feature (1)...(882): n = A,T,C or G
ttatnttaaccccttttcgaattccgttgctgtcgaaagaatccacactgcccaggtcggggagcagtggtggccagcagccctcagggatganngagggtgtcaagaggtatgaacaggagcatgctgctatccaggataagctcttccaggtggcaaagagggaaagagaggctgccaccaagcactccaaggcatccctgcccacgggcgaaggcagcatcagccatgaggagcagaagtcagtccggctggccagggagctggagagcagagaggcagagctaagacgccgtgacaccttctacaaggagcagctggagcgtattgagaggaagaatgctgagatgtataaactgtcttcagagcaattccatgaggcagcctcaaagatggagagcacaataaagccccgcagggtggagcccgtctgctcanggttgcaggcccagattctccacttgctacccgagatcgccccgcatgaagtgcttgcttgtgctcggaccttggtcaangcattaccaacccttgcgtgaagcgcccgccccacaaagggcttgaaggaaccaaaacattcaatttcccttgcccttggccaatggactttgggaanccccttgaaanaaagggganccaattcattggggaanccacaaacccacttgtggccccttgncccgntttttccttgcttnggggccccccttgccattattgcccccccttgaaaccccttgggggccttgncccaccgttnnttttaanggaaaaaccaaaaagtttttgccnccttaccttgttcttggnaaaaacccaaanttnaaagncccnnattgnccccttttggntttttcnaaaaaaaaaaaaaaaaaaaaaaat

SEQ ID NO: 2477 - DNA, 769 bp, Homo sapiens
  misc_feature (1)...(769): n = A,T,C or G
ttacttttaaaccctttcgantccgttgctgtcggaactgtttatcttatcctcctcagtgatacatcatgaagttgtgtgctttgcctaaaatgcccagttacctgaaattgtataaattcttgccaaaagtgtttgaacttaatacaaacttcccatctcttacctcttagcactgtgctcatcttgaggggacatagtcccaattttgtattttatataatactgttagtgaatatgtgtagacttcatatggttgtgggtaagagaatactgcattcagatagaaaagatgctatatagctaagttgatccaggatccttgggctacctgctaggcagcttgtggtgaacaatcataatctctaaaaaataccttgtctggaccgggcgccggtggctcacacctgtaatcccagcactttggcaggctgangcgggccggatcatttgaggtcaggagtttgaaaccagcctggccaacgtggtgaagccctgtctctgctggggatacaaaaattanccaggcatggtggcacatggctgtggtcccancttcttggggangctgangcangaaaatcctttgaactgaaantcaaggcggaggtcgcggtaagcccaaaatccaccatttgcactgcancctgggtgaaaaaaaacaagcctncctntcaaaaattaattaattaattaattttttnnnaaaaaannnnnnnnnnnnnnnnnnnnnnnnnnnnnnnnaaaaattttnccggcccctttttcn

SEQ ID NO: 2478 - DNA, 780 bp, Homo sapiens
  misc_feature (1)...(780): n = A,T,C or G
cttactttnaancccttttcgaatccttgctgtcggcagtagggggagtggggaagggacttctgcatcagggcatagcatatgtttctgagatnactggaagaagctagcagtgccaggagcctaaagccagctcactgtttggtcgtccagtggagcaggtacagctcacagtccctaagccagggaaacctggctgacttccactaaagtcaagcaagcctggtcggcctcgattagccaaggtgtggactcttcctccaaagcccacctcagcccacctctgccagggcagagaagccaaaatggtcacattgcagccaaaatggtcacacccttttgctccagancagaatactgcctctcagtcttccaggtgcttgaggataactgggggcttcatttaagtgcatattctgattctgtangtgggggtgggaactagattcagcatttctttcttttctttctttcttttttttttttttttgaaanagggtnnaantttttcncccagggtggagnggaggggcccaattttannttnaaanaaaccttcnccttttngggttnaaaaaaattnttcccccccanccttcccaaataatttgggnaaaaangggtttncccccccccttccccancngaattttnggnttttttggggaaaaaacnggggttttncccattttnaccaagggtngtttnaaaactctgggcccnaaaanaattngcttccttnggcctttcaaaaaagcngggattanccggggngaatnn

SEQ ID NO: 2479 - DNA, 1218 bp, Homo sapiens
  misc_feature (1)...(1218): n = A,T,C or G
nnnnngngnnnnngnnnnnnnnnnnnnnnnnnnnnnnnnnnnnnnnnnnnnnnnnnggnnnnngnnnnnnnnnnggnnngnnnnnnnnnngnnnnnngnnnnnnngnnnnnnnnnnnnnnnnnnnnnnnnnnnnnnnnnagntggnttnntnggcncntcgggaaancccnngnngnnnggnnnngnangnnnnnttnnngncttntntgnggnggggggggngggggggggngtttttttttttttttttttngnnnnnngnnncnnnnnggggggngggtgggggcgcncnnnnggggnngtgtgttgccnngggncnncnngnnnnnnnnnggnngngnnnnnnggnntgnngnggngnngggngnnngggncnngggggnnngggnnngggnnnnnngggnnnnnnnnnnggnngnggggnggggngcngggggnnnnnnnnggnnnnnnngnnnnnnnggggggggnggngggngggggngnnnnngggnnggnggnngngnncngnnnnggncnnnnnngggggggnncnncgnngntnnnggggnngngnnnnngngnnnnggnngggngggggggggnnnnngnngggnnnnnnnngnnnnnnnggggngggnggggggnngggngnaannnnnnnggnnnncngggngggggnngnggggnnggnnggnnggnggggcnggngannngggccnnnnngggnnngnnnnnnnncnggggggggggcnggngggggggggnnnnnnnggggnnnnnnnngnnnnggnngnnngnnggnnnnnnnnnggggggnnnnnggannggggggggcnnggggggggggnngnngggggggnnnnnnngggggnnnnngnggnngnnnnngggnngnnnnnnngngnnngngggngnnnggnnnnnngggggggggggggggggnnnnnnnnnnngggnggggnnnggggggggggggnnnnnnnngngngnnnnnnnggggngnngggggggggggnnnnggggnnnngnnnggggggggggggggnnnnnnnnnnnngnnnnggngnnggngnggngnngnnngnngnnnngnnngngnngnnnnnggggggggnnnnnnnggggggggnngnggggggggggggnnngggggggnggnnnnnnnnnnnggngnnnnnnnnnnnnnnnnnnggnngggggggcnnngnnggggggnnnnnnngggnggggggcgc

SEQ ID NO: 2480 - DNA, 1186 bp, Homo sapiens
  misc_feature (1)...(1186): n = A,T,C or G
cccntnnntnnnnnnnannnntnnnnnnntnnnnnntannnnannnnnnnnnnnnnnnnnngntnnnnnnnnnnnnnnntganntatcgantanntnncnnnnncanntngtannnannntnntnnnnnnnannnnnnnnnnnnnanaaaaccttcgaccnttctcagcgggngacgaaacagtatatgtaggtagaaaaagaaaaagaagggtanggtcttnagcncnggtggacnggggannttaaangcttagggggatanggaataggattannangggagacccaaggggccaggaanggtaggaaaagctaccaaggnttggtnatcctaggaangaaanaaaaggnntttnaaggaggatgtgatggnctggggcnaaaggtngttggnccagncaantaanttgaagattgagaaatgatccnttgggtgtagtggatgaaggcaatagtngaactttgggantaaaacctgttttcaagtgggaggtaatgggganggaaatgccntgttggggaantgagnttcaaggtaaccaaccnganggaggagaaaacttggangaatagccaagatggtangaattaagaanttcccnaaggggngttttttngnttggtccaaagggnaaaaggaatngaatttggaagaaatggggaaacntccgaaagggggnggaggaggnaaaatntgaggaattttttttaaaaaaaaaataaattanatttanagntttggggggagnaaaaaggggggcaatttgggttggggaanttctttaatttggggcgatnccaccttccacccacnaaggaaaggggaaaaaaaatgggggattgggatnggaatttccaaagggaacaaagttggggaaangnaagnaacacgcaagcaaggtngngtcnggggnttcaaggattnggccttaaagccctncttaaaaaaataggaaaattgggtnttaaaaaaattancaaggtgggggaactttcanngnccctggncaaanctggggnncnatgggtgccccntttaccttggggaacccccctttccccattnntttgggccgggtatatgnttttttggaccttaaaccaagaatngggggngaccanttttttnttggagaaaaaatgggnaaaaaaaagnangggcnccccctanaatttccaaaann

SEQ ID NO: 2481 - DNA, 1101 bp, Homo sapiens
  misc_feature (1)...(1101): n = A,T,C or G
ngnattttntnaaaaaccnccttttttgcggaaaatcccgtttngccttgntnctcctaaaaactaacttctcccccttttggntcacccccccccntaaaagggncanaaagagagattggngngggtanngggatttnttttttntattnaaccntttnttttgggncnaaggggccanagccccnccaaaaaagnnangggggggggggaaaaangngngnggtgaaaagcgnttctcatnnaggccaatcgnggggggnannanagtntcacccccacctgtgggtnctntcttnngggncaanagggngncccttanaaannnttataanctntttttacacttcccccntttcccctttnnggcctaaatggaangaanggacatcatnaanggccnngaaagnggggnaccaanggnggncnttcctggctnnnccttanttggggngaagggnttccctaggncaccaagactcaaccttnntttctngcaccnncctttttnccttttgaaanannanancaacntnctgnaacaaaatcnactgcttggtnctgcttttgangggngtaatnattctttanccnaanctctggaanttggncaattctattttttaaaaacctctaaannangggnananaanccttggtnntnanaattgatanacntnngnttccnctnanggtacatggttggntncaagaaccctatttnntaccntatgnaanacangtctntgatttnctngcaaannnaaaaaataccctttttngnggaanantaaaggaaaggaggcttagnngtncccantgcccctctttggcccttnaacaggatngtcncccanaggggccccccatttntggcntttccttgncccccctnccctggnntnacctngnttngatngcacttcttcctttttccctgnnaanacccctgggttttnccnaagtncttncttcctggnncccctttctaaaaantcctnttggaaaatccncncttnncnccancctctntgggttcgnaacacttgggnacccaattgggcccaatnctctnggctggntnnctntaccccnnanccn

SEQ ID NO: 2482 - DNA, 1093 bp, Homo sapiens
  misc_feature (1)...(1093): n = A,T,C or G
ncttacgcnttngngctgtcggtgatttgtttctattaaaaataattttcaagtgggtttcttgtnctttagtattgaaaactttngtggtnnttttannaancttnggaccngttttaagagaantcagtaccctttngttcccctntttggantcctaaaaaaaaangtcaagttntcatgnccaggcccgaatagttcaggcctggtaaccttanccctttggggnggccaaggcagaacagaatgaacctcgtggaattgggcccacctcanccctcccaaaagtngctgggtatttancaagaatggtggaagccccccggcacccccaagccctggaagttttcctccttttcctcttcttttttttaaaccttttaantttttttttggaaaaaaaaccccccgggtaaggaacttttttggttggggggggaagccatttttttttgggtttggaatnaaatttttttaacctgggaatcctnaaaaaagccctggaagtgggaatttttttttttaaaaaaaagnaaaatttttggnaaattttttggggcctttttccctttcaaccccaaggttaaaattaatnggttccttccccctttggccnttttccttttttggaatgggtnggaataaaggttttttttggaaaaaaatnggggggttgggaaaaaaaaattcnttaaaattaaggaaattccttgggtggggggtttgggaaaatttttgggccttgggggggtttggggtttaattggaaaaagnttccccaaccccccttgggtnggggggcccccccaaattaaacccntttaaaccctgggtttgggggtnaaggggaaggtttgggtttttggaagnccttanttttcntnggggaagaaatttanttttnggggtnaaaagggtanttnccttaaaaaagncccctttaaaaancccatggttnttgtggcccccttggttttggaacccagttaaagnccccctttnttttggccatttggaaagacnntttgaaagaaaataatccagcccttgcntnaaacttatgggtggaaagtnttccttcncaatttttntt

SEQ ID NO: 2483 - DNA, 894 bp, Homo sapiens
  misc_feature (1)...(894): n = A,T,C or G
ttnnctaagccctttgggntgccccaggtactattagaaataagacaaaaacttttgcntcnaanaacctccnaancntntngganntnttntttngannggggccaaccaaantnccccaaccnttngnccnccnnanccnagggctttnannnangccnngccanantgggcntngcangaaacacttnnngccntttnggaaaggggcccnttnntntaaaannctnaatngccnatgccnngaataaaganggtgtncctntngcaaangaatatcccaagtgctaaggtccaacccaaaaaggcctngtaagangggantcaagtgtnggtnaccaagccaaaggatngaanggaanggccagtgatttgaccaatggggcaaagaatgaaggggacccaagcttgtgaagggcccnatttgntaacctgatgaaattggatttttctnaaanaaaatgggggaccaagtataactgtngctatttgancccttgaaatgtggcttgttccgaatttgagatttncttnaattccaaaaattcacccctggatttttaaaagaattttaaataagggaaaggcttgggcccccggtgggcttcaccgttcttgttaaattccccaancanctttttgggggaanggnccaaaaaaccngggttngggaattcccccaaagggtccaagggganaaatccaaattaccccanttnccttgggccttnaaacaatcttctttacctttaaaaaaaatttccccaaaaaaaaaaaattttaaacccttggggcccctttgggtttgggcccngggtttgcccccttnttaaattnccccccaancnttacctttttgnggaaaggccttttnaanggcccngggaaaaaaaa

SEQ ID NO: 2484 - DNA, 935 bp, Homo sapiens
  misc_feature (1)...(935): n = A,T,C or G
ccccccncnnnnnncnnnnnnnnnnnannnnaanngnncnnannnnntncncnnncaacnnaccanannncnnnnnanncnnnnancncnnnnnnnanannnnnnnncnnnnnncnnnnntatnggaacccctagcgcaaacatggananccctaactcnntcaacctgggacggcaaaggggagggganggaanctaaccaaagggtaatggactttagaatcnacatatanccaacaaanccccgcaancctttgggccannancannctatttgggggagcagctgggggctggtaccataaaanagaagagccncccnaaaattntaaggccttttatccctggcttctaaccnnaaaaaanncagggagaagtcaangaagctagggttcaaggntgnccccccctcnaaaagggntttgggccaagcggnctaaaacaagttttccaacaactgggaaacaaaactgnttaagcccccaccccnaacntggttcactggggggacttttgctaacccgntcctggggggngacccttttcccggggattttccnttggtctttatcaaancaagaanttaaaccaccatggcctaaaaccgnncttncattttgacttctctactccgggngtctcagacaagtgtcttcccagaaaaaccaccaccctctacccaaagatgaaacatgctcatgncatttttctcatggncacatttaaacagttttgacatgttatacttggcgcatagaatccaacgtttcttggggaacctgacctttngagtgtttaanaaagccggaagngggggttgcccctgaaccaacagaatttcacctggggtcngggctcccggngnttaaacactggganacaatctttgatgngccgaaagnngagtcaatctttcngaacncantttgggaccg

SEQ ID NO: 2485 - DNA, 914 bp, Homo sapiens
  misc_feature (1)...(914): n = A,T,C or G
ttatcttacgctntngtgatgccggncctgtcgcttgacgcttggcctggctttttttgtganatatgngnnactttcnttctttattangnccctaaccnccccttcccnncccnaanaanggccattnnctncctnnngggnnnttncctaaaaaanaaattanaanggatngnaangaaanaaaggnanaaaccagnatttaanggnggtnggcttaacttggggccncctaacccacctgnttcaattnagggctngaacaaanctgaagcccctttgaaaagccaaggcttggccaggancaggggtgggggcccnaattacaactttccccatnaaaaccaaattttnttgaaagnaaattgtcccaaaantngcagttatttttcttttgccaagggaggggggaattcctggnangatggggtttcaatgttcttnttgattcccccanttnccttttttggggaanggcttgaangntnggggaaggggaattttgcctttggaagccccccngngaaagttttccntangaacccaangcccccttgggnccaaacnaattgggncggaagaaccccccattctttcttaccaagnaaaattttaaaaaaatntanntncatctnttnttntttttctttgggggncccgnttttttttacntttaaatncccnaacntttnttaaaaaaanctttttgtttanatttttggacnaaaaccccnaatnttttaattttttnnttnntnaactnctaataattnttnttttctcctatattcntntctcnttntttantctntttttnntactntttncnnctttattttactacncttcnntttntcttntntctctnntanttnnacgnacctactnctcttttttttnnctttnttcannnn

SEQ ID NO: 2486 - DNA, 1288 bp, Homo sapiens
  misc_feature (1)...(1288): n = A,T,C or G
nnnnnnnnnnnnnnnnnnnnngnnnngngnnnngnnnnnnnnnnnnnnnnnnnnnnnnnnnnnnnnnnnnnnnnnnnnnnnnacggacncntagggcccttcnccaaannncccnnaannagcnncnncnnanccnccggnccnggncccncctagcaggaacncggngggggnggcnggaanttttttttnggtntccgggggaancngggcaggnagaggnccatgggcnccccggcaccncncnaggcggngggncggnnggcgggancccnancantccnnaagggccgcancncnaanaccgggccngnggaccnggcccggggggggnngggaagggccaccccngcagaaaannaaggaagggcncccccgggcacccctcccnaaaacantnaaaagggncctggggnaaaaggccccanaaannnnaanaccaannggcngggaannaaacccnanaccaggaanatnnnncanggcctgggaggggggggggaggaggaaaggggggaaaaaggggngggggaannagggggnnnncccaancccccangnnaccanggggggggagggaanncccccaggggnacccggnnantnnggggagnnanaaanagggaacnaaaaatnnggggnngggcccggggaangggcccggggggggggncccaanggccccggggaaaatccccccaaaccaccnttttnggggggggganggggcctggaaggggnccanggggccccccccaaggncccaaagnggaannccacctntgggaggggggccccngggggggggtttnccggaggggacccccgggcccccnggggggccccaaancaangggggggggggaaaaaacccccccnaaaccccncttgccnctaaaaanaaaaagnnangtnagaaaaaaaanncnaagnccccnnggggngggnngggggnnggggggnggccaaaaaaaccccccnanannaaannccccccaggncnnncccttnggggggggaagggggccccgaagggggcccagggggangaaaaaancgggcctcnggggnaccccccngggaaaaagggggcggggaagggggntnnggccngggncggaaaggccccccaaggaaaangggggggggcccaccnggggggaccctncccaagggccccnggggggggggggggcccagggaggcccnnggggacccccccccanatctgggggggngaanaagaaanaaaanaaanggggcgccccnnnnngggggggannggcgc

SEQ ID NO: 2487 - DNA, 749 bp, Homo sapiens
  misc_feature (1)...(749): n = A,T,C or G
tttnaccctttcgatnccgtgntgctnnctntngctcagngctnctggnaaacacntggaggagancaaancccgccaggcntgnngctgntnttactgtttctgtggggnggggaanggggaagtnntgaaaattnccaggtgtgtntnaaactaaagggtttnaaannactgtnctgaaccagnncgtnttgaggtaaaaggcncaggattntncntgtggttggnaaaaatntcctgtntccaaantttgaggcaggaaatanaggttttgctggtgggattgtgggganactcctaganctggaaccaggaaagggggatccactgttttgtgaaaagggcattttcacntgaacaaggttggacagcagganccccttagggacccctgtgagcaggcgtcttgacttgttttttgaaaacanttaagacgancaatgtgatgtgaagcattcanagtaagggtaagtggactggattaaatagangggcaagttntatcatctttcttntgccccgtgcctcctgtttcttccttcatttgttcattaaacaaatgtttatttgatgggttatnaatgtgccanacttgcctaggtgcatgggaccgcaacaataaagtgagaccaagaagggcccagttctcacngngcttatatctaataagacagtgaataaataaacttgccaatcaaatctntgncatagctntcatcctttcanacataatttaaaacatntgaaan

SEQ ID NO: 2488 - DNA, 800 bp, Homo sapiens
  misc_feature (1)...(800): n = A,T,C or G
nacngaccctttggngctgtcggaaataacttcgaagtcctcttcctttacaatatttgaattcatatttgtnccttctcaaaatagtgnttcatttttcctagaattacaggagggagctcttttactaatgttgttttggttgncaccttggngggctantantaggangttttctantngtaaanaaaactctttagagacttttgactgggtcagtntactgaggggtggagatttgnttcatgatgaaaaagcctatagattgccaaaaaattaattctccaaaccacctttcactctcagaaaatgagaccccaaaggagtntgcctntaaatcaaatttgccaaccaattatgtagatattactcattctaggactaatgatgatggtaaagaagttgccagtgttatggcaatgaaaatttcagaaaggaggaggtggatgatcttctagatgtatatgaacacctgnctatatctgcatgtatatgttttgacctgccagtggtttgcaatgttgatatgtgttccaagaatantnctgtctacnaaactggaaggcccatgtcnaaattggtcctttattgggngggttttatnggcaccgtgggaacaattttcttanctaaacctaccaaaagggtcttctttggatggaacaatttttantttattattttacctnaanccttttttnnnnnaaaaaaaaannnnnnnnnnnnnnnnnnnnnnnnnnnnnnnnnnnnnnnnnnnnnnnaaaaantcttgggggggggggntttttaaaaaaaaaaan

SEQ ID NO: 2489 - DNA, 1043 bp, Homo sapiens
  misc_feature (1)...(1043): n = A,T,C or G
cnancnataccncttttcgannccgagnccggcganaaanngaatggcctntntgttcagnanggatccncctccngctgnttgnttcatgtttttgttcctggnccaacgctttnccatntgtngnatcntaatccggaattanttggctttttggggttntttaattttttgaaagggagnttccctttgtngcccaggctngaatngnattngngccaacccaacctcgttgaaancttctgcttccaaggacaagggaaaatcctccaaccttaagcctttccacgtancctggggantaccaaggcaatgcacccacaaggcattgcanccaacccnccccaacctaaatttttttggtattttttnggtaanaanaacaagggngtgggcaattaaatnnttngnccccaagcctttgggtnnttttggnaaatggccccttggaagccttcaaaaanccaaatttttaaattttngccccctttngggcccccttcccccnaaaaaagnggcctttggggggaaattaaaccaangggcccattggnaaancccaaccccaaccggggccccaagcccccttttccttnaaatttntgggattttttttttttnnaataaaaggggaaaangccctaatcctccntttcttttccccctttcccccnaannttangggggnnatttccnttttttcccccttttccgnccaacntttggctccaatgttacntnggaatttcccttcaaactttcatttaatngaaattcccattttgggnaaacccaattggaaaaaaanggccaaccttccanaaaaagccttaaataaaagaaaattggttttgggngggaaatatccttcctaaaaancttattcttggaaatanattttcccttttaaaatttggggaaaaccctctttttngggagaccttttgaaaaacnttgggaaaaaaaacccccangggaagtttgtattttnggaaaaaaaaanaanaacttngancctttggtaaaanaaaaaccaagggann

SEQ ID NO: 2490 - DNA, 1196 bp, Homo sapiens
  misc_feature (1)...(1196): n = A,T,C or G
cnnnnnnnnnnnnnnnnnnnnnnnnnnnnnnnnnannnannnnnnnnnnnnnnnnnnnnnnnnnnnnnnnnnnnnnnngcnnnnngnnnnaannnnnnncnnangcnnnacnnnnncganngnngnagnnnncnngnnngnngngnnnggnacnnnnnnannnnncnngnnnccncnnggnnnnnancnnncnnngcnnnnacnnnnnnnnnnnnnnnnnnncnnnngntcngatccgggaaaacccttngcgcgcaagnccnncgcgggggcggaagngnagcccaccncgccacgcnacggggnanggggggggccgcccgccccnnnggnccgttggacgggcccggccacccggggccggggacnngacccggnngcannaggcgacccannnccgggccagcgaangnggccnganggcaacccgngccaggganggnaccncnggnaggnnggnngancanaacgggangggnggccgcccgggnnggccaggaaagcaagggccnngnacnacnnggcccccnggaaacccngngccannaaggcggannngangnagagaanccnaaaccggccccncagcaagnnaaaaanngacgnggggaccanccancngccgggacaccggggggaaaaacnncngaaggagnngggggnaancgggccacnaangnnccaaggcnggggnnanaancgacccggccccaaagggggcccaaagggggnaccaggnccgnncngnggggccncccccnggggncnngggaannaccagggccccgggncccaanggggggcccggggcgaacccccccccccnagcgggggggggggacanacngccccccggggggggggggcccagggaggagancccccccggggggaannnnccccncaaggggggggccnanaaagggggccngnggggggggcccgcccgnnccaannnacgcgccaccaaggacnacggaggggggggccnacgccnggggganangnggncgnnaaacccacggggaagccccacnngggccgnggccngaaaaagaccccccccaancccccngaaagaancagggggnnggacnnaanntnccnnaggggggggncnncacccnggngannnccaacgaaccgggcggaaanaaaaaaaggnggacggangnancccccagcccccccgggcg

SEQ ID NO: 2491 - DNA, 855 bp, Homo sapiens
  misc_feature (1)...(855): n = A,T,C or G
naaaannaagccctttgaaaactncgttggaaaaccaccaagggtttagtccactctgcccccaaatcctgagtctgctganntnncnccnttccttcggggtgggttnaggangtgnccctggctggtngggagggtgancctctgaaataagggtggggagtcatncagggnggcctgggcccntggggggggggttaaacctcaaaaaaaggggagggaaggcttgggcactgcctgaaccatttcctctacagccagacccaccaggtggcggacccatcatcccanctctgcantataatgggattgcatcataatcaagccctgaaaataactgggaccacctgcttcccccttcttgataaacaacacatgtgaatgcaacctgtcagtcgttggaaagttgcngcatggaaaggcaattnccaaatgactttttaaaaagtatgagaaatttgcctggcttgaaccgtttttttaaattaatgcccggggaggtttaaccatttaataacctatttcattaacctttaattngaagcctngggccttttgaangggnggggnttttaaagggaaaaacaatttttgggggnattctntnttgggccaangggggaaccaaaaaatngtttgtaanccctggggnccccgggtccnggccaaacnttttttttaccaaaaacccctaaangggaccctttcaanggggttncccgggtttggccnccatttaaaaggnaccccggggggaangggacnaaaaaaccttttttttngccnaaaaaanggggngnggggggcctttttttatataaanccattttgngggganaccnattttttcccccg

SEQ ID NO: 2492 - DNA, 673 bp, Homo sapiens
  misc_feature (1)...(673): n = A,T,C or G
ttaaactttacancnttcgtgtccgtggaantctgggtgttnggcccgccnttcgntggnctcncncnttngcngancctttttncgcncttnccnganaaaaaaaaaggnnggccnannccgaccttttttcnngccagnnngnttttngggggnccnntaaangncntggntnaaggccaaggncccnttgggncctnggnnancaanncccgtgaaggatnttcggggnagntcattngancnganggccacctnaactnnccgatgtgcaacatcacaagcacnttcnaaaatngcccgatggcacaanttgagcaaggtntccttccgggcaccnaaatccgctttttgaatttgcctgactgctgaaaaacccccctgttaaaagcatgaaaataanaccaaagctcagggctggccgaggaaacttgcattctcaggccaatggcccaaaagaaaagacgtggatgggacgtggaaacattttcaaagcgagatatttctagttgacagaacttgtcttttcttaggtattgagtcttgagnggtgcttggctattntaggatnttgctctttcttaacagggaatgttactaataattggggnttttgtcnaaaccnnagaagagagctntngaaatnnggnccnacatctaccntnttnnccan

SEQ ID NO: 2493 - DNA, 837 bp, Homo sapiens
  misc_feature (1)...(837): n = A,T,C or G
cgaactctttagacctnncgaatccgtgctggcgccagacactggntnacccagagcttccgcangcannaccnnatgggtttttnnccttttngtaaaaaatccaaaagaagaattttngantaaaaaaancaaantcctgtttttgngcctggaaccacnttgnccaggcangttataaancagggtnganctgggttagccccacccagnancgnaggnnggcctcattggngaccctcctagcccagcntaaaagggcatcaccctgcgngtgctcacaaagnaatatggaattttcccttgcggggccttcaattgtggnatnnaaagaaccctctcttgtgatcctgtgtcctgggtgctctgttggcctccttcntgccacccgaaggaanaacatggaggcttagagaangggctcactgaacaancgaaaatgnttgggaacnccaaaggagctnccaaacacaaaggagccatgaatggggcctaggctcttccccnagggctggggtggcctcaaccgtcttgttgggcaaaaatcctgcttcccttgacacancgggggcttaanaaaccaanccctgnggtcacacaccctggtggaattaacaatgcctggctggacccctcactgggagaaaagggctacaccgttttgtggaaccaaaagccaaaaaaaaggtgttttatttnggaaaaccaaaatccaaanctgnncattttaccttttaattaanaaaattcntttngggaatttggctnatgccctataaatccccaccaccttttgggaaggctgaaggtggggaaaaaaanaccccgancccaant

SEQ ID NO: 2494 - DNA, 744 bp, Homo sapiens
  misc_feature (1)...(744): n = A,T,C or G
tacccttcacntactcagcgggaagataggcaatgccatttttttcagatgtacacntgccacacacctaaacataggtttaaattatgaagaaatttagaatagaggtttattagatttagggaacactaagaacaaaaaaggaaggagtgatacctgcctgagtggacagctgtaaatcagctgtaattactgcagttgtaccaatagttgtgagtggctccagtcactttaggagtccttggaagtacttggtacacatttgttggctgtaccttaaaggaagtggcaagtccagtttgttctctctaccacactagactgccactgacaagtttgggtctgttggattcaaaattttgtaagccattttcacaagtacaaagatacattttaaccttgtcttctccaaaattactgagtaggaattttatttttatctttttgagacggggtatcactgtcacccagactggagtgcagtggtgggatcttggcttactgtgacctctgcctccgggttcaagtggtcctccctcctcagtctcctgagtggctggggcggcangcgcgtgccaccatgcccagctggtttggtctatttttctgtananacngggttttgccatgttgccgggcttggctcanactcctggctcangcgancatttcgncttcgnctcccaaggngctgaaattatangtgtgaaccccagcatctggccanantgagganaaataatg

SEQ ID NO: 2495 - DNA, 1593 bp, Homo sapiens
  misc_feature (1)...(1593): n = A,T,C or G
ngnngnnnngnnngngnngnnngnnnnngnnnngnnnnnnnnnnnnnggngnnnggngnnnnnnggggnnnnggngngggnggnggnggnggnnnnnngnnnnnnnnnnnnnnnnnnnnnnnatnaanntaaacncttgggaaancccnnnnnntgnnnnnnnaaggnggggnggntgggnaagngaggnggngnngngngnnngttnnantnttttnttntcngnnnnncnggngggggggnnnngggggggggggtggnggnggngngngtnganntttttttngnngncgnggnngnnnngngggggagngggggnngngagngggncggngnngangngggggggggnnggnnnnnnggnagnggggggngngangnggggnangnngggnnggnngggngggngnnggnnggnngannggggggananncnggggangngggggngnnggnnnggaaaggagaanngggnggngggnnnnnggggggggntgggggnnaagggaangnnnnggnangggnngngggngngnggnngggnggggggggngnnngcgnnngannnngtgggggnggggnntgngngngcnggngnnagcnannnngggnnngggnggangggnanggngganangggnaanngcgggggnngagngggnngggnnanggtnnggggnnngggnagaggngcgnaanngggangggggggganggggggaaggggangngnggnncncngngngggnngggggganggnnngnnngggggggggggcgnngnngnnntnggnngggnngggggggngnncnngnngngnnanngnnngnnangggggggagngggggnggngnnggngnggngnncgnnggcnngnnggggggggggnnnaagncnnangttggggggnnnnnngngnggnngggngggggcnnnnngnnnanggangaggngnnngangcnnngggnngnnggggaggggggggangacncctgnngggggggggggggggggggagtnngagggnngancgngnngannnncggnntnaaggnnngggggnngaagangnnnnnnnnangngggggggggnggngggggggggtggcggnnngggggagggtggggggcncaanggggnggnnnnncgggggggggnananggggggggggggnngnggganaanagnaaagggnanggggggggtnatgggggggnacgcggngggngggngggggnnnggaanaggggggggggggggggggngggggtngggggtnnnnccgggggggggggngaagngngngnggnaagggggnggganngggnnagggnaangangncngngnggggaggggaaanggnggggggnggggganngnnngggnngnnnnngggcngggggggngcangannaggggggngggtgggggangnngggggngngggncgtaggggggggggagaagnggggggcanngntcgcgnncggngggggntanaannnganggggngngtgtggggngggggcnntgggggannnaggggnaggggnacggggggngnaagnnnngggnngctaggggcgg

SEQ ID NO: 2496 - DNA, 730 bp, Homo sapiens
  misc_feature (1)...(730): n = A,T,C or G
tattgaccnctttcgattccgtgctgtcgcaaactttcttttgtttcaccagtgggaaggaaaaaataaatgtgaaccaaagcaactccctacntttagctcantggggtggntccnttccttnttgncngggtcttggccctttggttgncggccnaggaaactattggtgatcccacctttgggctnagatgtgatgggangngggatgtangggcccaaggagaaanggttgcagccagcggtcaagcttggaacaaanacctncangcgggtccctggtgttctgggcagtcacgcccaactgccaaccgctttgcttgcactttcactggggttaaaagaanattcttcccttccaagaatcccaaaaacccgctctctgccagggggactttggaattccacacggatcaagaacaaggacacctttgcctgggaacaatttggatgggagctctcctnctcgtgtccactggaaagacatttaggaatcaaattcaaggaagaaagaccccgaaaanggganttgggaatgggtgtgtgtgagancatatgttggttttgtgtgtgtgtgtgtgtgcntgcctgtgtattttcacttatatanaaaaatattgnttttttaacaaacatntatccaatttnttgtntaaaaaaatatcccttcgcgngttctatcaaannnnnnnnnnnnnnnnnnnnnnnnnnnnnnnnnnnnnnnnnnntt

SEQ ID NO: 2497 - DNA, 754 bp, Homo sapiens
  misc_feature (1)...(754): n = A,T,C or G
tnanttaccccttttcgaatccgttgctgtcgcagaaccagccacaggtttcatcgacggtgacttgattgagagtttcctggatattagncgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattggcctctttttatttaaattggcagtgtagggagttgtgggtagtggggaaanaaggttaagaaggtttcattgtctgtgaagtganaacctncntttacttttcntttattgcctctgaaaacattaaggcctaaaggcctgactgncnaaccatgggtagcccn

SEQ ID NO: 2498 - DNA, 752 bp, Homo sapiens
  misc_feature (1)...(752): n = A,T,C or G
tgtntgacncctttcgaattccgttgctgtcgcacacagcccctctgcaaaggttgggaaacttgcaaggaatttaaggaaatctctgttnagtcattagccagccactaaactaactgagcagatccttcagtgatcacacacaacaaagaatacagactttacagacttagtcctagaaaatcactacacaaacagcacaacaatgcacctgggactaagggagaggagatgagttccagagttggtatattatttaaatgtctagttttcaataaaaacaattataagacacagagcaaaactagaaagtatggcccatacccagggaaaaacaagcaaccaatagaagctgtccttgaggaagttaatatcttggacttactagaaaatgactttaacactagttattataaatatgttcaaaaaactaaaagaggccaggtgcggaggctcacgcctataatcccagcactttgggaggctgaagcaggtgggtcacctgaggtcaggagtttgagaccagcctgaccaatatggcaaaaccctatctctactaataatacaaaaattagccaggcgttgtggcgcacacctgtaatcccagctacttgggangcttgaagcaggagaactgctttgaaactgggangaagaagttgcagtaagctganatcacccactgtcttcacctgggccacaagagtgnaacttcatcttccaaaaaaaaaaaaaaancccttnatttncct

SEQ ID NO: 2499 - DNA, 759 bp, Homo sapiens
  misc_feature (1)...(759): n = A,T,C or G
ttntttgacccctttcgantccgttgctgtcgatgctcccaggtctccagtgtcacctctcggtacagtgtcctctgggccaggtccagctgttcccactcctcctgtgtgaatgccatagccacatcctcgaagcacacagatgcctgaaacagggcacttgttactgctcagagaccccaggtcctcatgccctcacggaggtacctgttaaggcctaaatgttggtgtccccccgtaaaattcatacattggaacctaatacccagtgagatagtgttaagaggtggggtctttacaaggcaattaatgtcctcataaaagaggcttgagggagcctgtgttcaccttctaccatatgaggacatgtaagaggtgccatctatgagacagcaggccccaaccagaccaactctgttgacacattgatcttggacttaccagcctccagaactatgagcagtcaattctgttgtttgtaaattgctcactctaaggtatcttattatagcaacccaaacggactgggacagctccatgtatgtggtctgtaccattccttttcttgggcatctcacctcttgccagtcacagcaagtggtcctgatttctagactggaaatgacaggaacttcactaggagatccttacccctttcttttttacaaaaatcacaagattcgaaatgaggtaagaaagaaacttttaaatcnggggtgggaaaactgcagcctgtaggacaaatcagggcttgngggg

SEQ ID NO: 2500 - DNA, 773 bp, Homo sapiens
  misc_feature (1)...(773): n = A,T,C or G
ttattttaacncctttcgantccgttgctgtcgcttgacgcttggcctggctttttttgtggagatggggtcttgccgtgttgcccaggctggtctcaaactcctatgctcaggcgatccaccctcctcggcctcccatagtgctagggttataggcaagagccactatacccagactggattagatttcttcacatgacatccgtagagtgcctgtgtgtatgctctgtggatgtaaaatgaacaggcaagagtacagaagtagaatctctagccatgcagtcagacagatggctccaaaattagttacttggttatggagacgatcaagttacttgactttgagcctcagttatgtgccaaatgaggatactaatagtatctatctcaaatgcatatatgggtgttcactgtctctgggagacattttccaaagaaaccaagactaacttgttaagggaatagatttctctcactgatacaggatgtgctctaactggccccacgatactgcattgaattacaagtgtttcctaagtatctgtgggggatcanttcaanacctctcttgaataccaaaattgaggaagtcaagtncctgatttaaaatggcaatagtatttgcatntaatctantngcantcctgtattaattttggcattctctanaattccttgtaataccctaatacaaangtaaatngnttggtnagtagttantnctgntatttcangggattaatgaccaaaaaaaaanaaatntctatacattt

SEQ ID NO: 2501 - DNA, 1156 bp, Homo sapiens
  misc_feature (1)...(1156): n = A,T,C or G
gnnnngnnnnnnnnnnannnnnnnnnnnnangggannnnnnnnnngnnnnnnnnnnnnnnnnnnnngnnnnnngannnnnnnngannannnnngnnanngnngannananncnnnnngnnnnnngnnnnngnnnnnnnngnnnnnnnnnnnnnnnnnnnnncaaaaangaaaacccttttngnnaaancccncnngcngggncggcangnaacacccnggnccnagcanaagccccaccggnggcagggaagncacctgtctcccttcagcaacagcncngcacnnnaccgnnggangcgcnccnnncaggacnanggtcagcagacnncnaagacgggccccaaagaaggccaccnggnanncaagngcaccgngnancaccnccncnngaangagcnggccnagngacgncnaagngcacaagaaacggnggggaaaggggacgggganaacaannnccagaaanaagggnanaaaagacacngngggcngggngcggggggcncacgccnggaaacccagcaccangggaggcngaggcggggnagacacccngnacggcagggaggncgagaccaggcccggncangaaggggggaaaacccccgccncnacnanaaaanagnaaaaaannagccngggccanggggggcanggagccnggnaaacccagncnaccnaggggagggcnggagggcagggagaaaaccgccnggaacccgggggaaggncgggaggggnnggcagccgaagccaagangaaaccacngcccaancggcaacancccaagccccgggggggggggaccaaaggaaggcgggaggaaccnnngggggcnnccaaaaaanaaaaaaaaaaannnggggggaaaaaaaaaaannaangcccgggggggccaaaggggggggggggccaaggggangccccgggggaaaaaaacccccaangcnaaccnnggggggggangggccngggaangggccagggggnaaaaaaaaaccggggcanggggaaaacccngggggaaaggggccggnanaggganngggcaaaaccgngagcccgaaaggaaanncaccgccccanacgggnaacccncccaaagcccgggggggggggggacaaagggangcggagggaaannngggggcccc

SEQ ID NO: 2502 - DNA, 796 bp, Homo sapiens
  misc_feature (1)...(796): n = A,T,C or G
ntttgacgcnttcgcggntgccggagctggcggnaagactataatatgactttgtgcatgcccgggagggctgccttgtagagaggatgtgagcagcttagtcgctcatctggccctgtgattcaggcttatggagcgttaagaataacagctgtcaaatggcctagacatggttaatgcaatttgttgctagtggaaatcctgaattgcttcctttctgtgatcactgctacttcttaagatgcttttgatgaatgtcatctgccttacaagttgacacctgataacttctccctgatgggtttccgaactggctgacttaaccaaaaagccagctcttgccatctatcttgcattaaaaggaattcctgagctcctaaggggtcagctgccccactcctgacttttttatttttaatggtctataccttctgcaacatttttgtttatggccattttgaatagttgggactttgactcctcacttgtgaataataggaatatatttttgcagaatctaacataatacccttaaaattcatactggacaaccatcaagtgtgatgtataagtatctggtgtaaacaaattttattcagcatattaaattattctgtggttttgcttttncttgataatgtaggaaggtgcaccaagtacccaggttttttcttctttggtgggtgggctttaaaaccgcctggaattggccatttttggcatttggtcttacttgaaaaanncttgtgggcaagcngantngggtanttattngacccatggttgtttcttcatn

SEQ ID NO: 2503 - DNA, 723 bp, Homo sapiens
  misc_feature (1)...(723): n = A,T,C or G
tgtttnaancccttncnaatccgtgctgtcgataaaataatgcatgtaaggccctcagcatagtgcctggcacagaattactgctcaaatgttagctgtcgtattaatattgtcacttttgcacactgatgtacatttcctgttgaccaggctcattctttaagcattctccatgcttaaaccagttccataatccctaggcctgtactccagggattgagactgaaaggatcatttatgccatgtttctctaaaagcatcattgctggaagacttttgataagtctgatgtgtctcaagctattctcaggccttttttgtagagtttagaaatgaagtatttgaatcaatttagtatctcctttactatgtttctccttttaatctcagccaaccccctacctgcaggtaaacccagcattcattaagagctgggttggggtactctattctgtatgcatcataatagcttaacattatttagtagctgtaacttacangtttaatgctagatgangatgtctcaagccgtgagtgtgcttgtgtaaaatggtggcaccatcatctcgttggaggaattttacttgaatggtattttgggaaaatgtacanattcttntgataaagaaataaatgggttgtgtnaaaaaaaannnnnnnnnnnnnnnnnnnnnnnnnnnnnnnnnnnnnnnnnnnnnnnnnnnnaaaaattcnncncccnnn

SEQ ID NO: 2504 - DNA, 843 bp, Homo sapiens
  misc_feature (1)...(843): n = A,T,C or G
ttatnttaancccttttcgaattccgttgctgtccgagcaaataccaaggcctaaaaaagaatgaattatttgctgtttgggaaatggaagccnnngctgagtgctgaagcacagggactctgcgcaggaagaggaggggaagcaagaaatgaatttgggtccttgtgatggcagtggctgctgccatcacgctgtgtggctagggctgcacacttcatggagccggtggaagccccgtccctcatgagttgggactggagccgcaaaccgctgctgcagacccaggccttctgctctatggagcaggcaggagccccaccctcttgggcagggctacagccacccaaactgcagctgtggatccgagcctctctgctcctgggggagccgggaacaggcagaatttgcccttccagatgcagctgcagcccgcgcaggcagganccagggacaaagtgggagcccttgcctntttccaaagttggcggggtggggagctcccaagtgcagcttgtggcttgcccccccangcacaaggaacganggcattttttgcaaccctgcacccatcgggccattcccaaggaaaggacaagccccccttttaacccttccattcccttgcaaggtttcaanggggtggttttggttttccaacttgncttgggccttttttttcaaattncnaacaaanttggttttgatttttgggaaggggganatncnggaancccaaaaaacctttgaancccattaaaatggccanccagggaaggnaaanggggggtgggggttnccccaattaaagggccccccccctttaaggcccangggaanggcct

SEQ ID NO: 2505 - DNA, 1448 bp, Homo sapiens
  misc_feature (1)...(1448): n = A,T,C or G
nacnnngnnnngnnnnnngannggnnnnnggnnnngnngnngnnnnnnnnnnnngtgggaangngannnnannngnannngtgngnannggggnngntnngnnnnnnagngngganggnnnggnnnggnnggnganngnaaggngngggngggncnntnnnnnnannnnnannnnnnnnnnnnnnnnnngnttntgattnntanaaccctttgggaaaantcccnnnnnnnnannaannnngggggggnngngggngnggnngntgagtggngaggngggaagggggggggntttttnnntttttttcnngngnnggnagnagnnaggggnntgggggggaggtacngngngncgnnnttngccntnntgngngagggcngngngggnanggagngnggangggnggcnngacnggggggngggncggcngggnganntgngagannnnggggcgaggagtgagnntgccgcgganngggaagcgggtngnggacgaagtngggangaggagcagaggannnnnggggngggngnggggacgnggnangnggagggcggggnnnangngnngcgacggggangggcggggnnangaantagggggngngnnggngctgaggtgngatnnngntgncncgtntangnngganggnananggngagganggnngganganncganngngngnanagngangganganangggagggagngnngngnagcgananantngncgngggnnntanggnngcgnngngngnngnngnganntgagtnagagnggntgngnngganntggggngcggggnngganggggaggnanaggatacgnatgcngcnngtggangnnancgangnacganggggngngtnggggggngggacgcggcanggagggtacggctnngcgagnatntggtnngggnncgcnacggcagatgcggnnaagnangggacngatgntngtgnnnggggcgnnggnngcgaacnnggcngngannnnngggnggaagnagggtnnangantcgngtgatgagngcggctgagnngaggnnntgnagngcgngncagggannngatgacgtnggggnngagacgangncgctcggcngagcncngcggcnngtntgntgtngggnggaanggcgngagcnnggagngngtgnggngtangngaggagngagngtgnntanggcgnntnnganngcgnagngnangntngngcanggaggngcgccgagntgcganggagngngangnnggaggaanngtggagaggcgngnngngcggagcgggagnnaccgnngcggcgggagggcgggcgnggtnaaganggtcgcgagaggtacggngggngggnggngntgaaggtgnggaggngnggnagngcanannncgcgggnnncgngagaggggncgcgtngngcgtgaggggnaacg

SEQ ID NO: 2506 - DNA, 673 bp, Homo sapiens
  misc_feature (1)...(673): n = A,T,C or G
tagctttaaaccntntcgantccgtgctgtcgggcgatgggctcttagtatcggaggattggagccatcngattnttacctgaaattccttagtctctcctgtgttggggaaatggtaagtaagacagattttcccaacagagagcgtntctatctcttctctactcctcccttttaaaatngagattctgacagtgtaaaggagttaggacccccttttggggatcgggcatggttttgtggctttaaaatgctttaaaattgctgaagtttcttggtttggaactgnantctcctaagtaacattntatcatcgcacgtgaaatactgtaactctcggtgccaaatccaggaaaaatgggcggttaggagaagtccagggaaagccgactgagcangttgtganggtaancaccctgttaaatgncacaaaaatgtcactntgcttctctaactaggaaaactgnaggacttttgaataagggnngatattagatttaaaaattanatagncatccctccaaaaccnttgntgttactggngagtgcagactgtataatattagaatagatgcgcgcgcggtactagctgagtnaacancagcacatgcaacctnttctaaatcaaatactgagnggctactngntcacctcganggagggatatctgacn

SEQ ID NO: 2507 - DNA, 772 bp, Homo sapiens
  misc_feature (1)...(772): n = A,T,C or G
nataacctttnaacctncnnantccttgctgtcgcccagagactggctcccagtgagctaagcccagcccgcgacccttggatgttnccagctgatttaatactcatgataaacccagtaggtcagtgccagtattatgagagaagtggaggcacagaatgtcacatccacctccccaaagtcaacagctaggagtgacagagccaggattctgccaggcaggttggcctcagaggccacacttcttatcccaataataaaagtgaacaagaacaggatgaagttagagtgagagagcgagagtggtaacactcatgcaatcagagaacaagagaaagctcaatggaaacatgtattcactgacaggattaaaacacaaaacaacaaaaagagagacggccgggcgcggtggctcacgcctgtggtcccagcgctttgggaggccaaggcaggcagatcccctgagctcangagtttgagaccagcctgggcaacatggtgaaaccctgactctactagagatacaaagattagctgggcatggtggggcatgctttgtactcnggaagctnaagtgggaaggatcgctttgggacccccggangcaaaagntgcanttgagttcaaaatcgcaccactggacttntaacctnggtgatagaatgagaatcctttntttnnnaaaaaannnnnnnnnnnnnnnnnnnnnaaaaaaatttcnngnggccnttttttttnnntccccaantttaaaaaacttttntngtttgnc

SEQ ID NO: 2508 - DNA, 758 bp, Homo sapiens
  misc_feature (1)...(758): n = A,T,C or G
tnncctttanacccngtgctgcgggaagataggcantgccntnttttcagatgtacacntccacccccccaatangaatggtttttantaatncnttttcccttntttncanggcttntcntgncngtanctattctttaantantaggaggggggagggtanttttagganttnctnccnccancagaaantaatggctggtggnttncccnttaaaagggtccagtagtatcattgtctgttggacatatagatcagttttttcttctaaatgctattcaactctctattattaacatatatatgtatgtgtatatatatgtatgnggtgtatattttattagaaaaaataatctattattcaactagataaaataagaggtaagagataacatagtagaactcaattatctactaaataaatattactcccattctctgtggaacacccaacaatattctcttcagggaagtgacactgactattgtagaaagaacaagttaatgtgaaaaataatgtttcaaggccttattattttattttcttaaagagtaatcatagagggggaagcataatacttcattaccatgtctgtagangaatggaagagcctnttatgccaataagaaatacaaggcattnctttggaccnttagtcatncttcaaaagaagtgggaatgtgtctcaagntctggttttatgaagaaatcaccatttttgaaaaatntggggatgnaaaaatgcccccntaaaan

SEQ ID NO: 2509 - DNA, 1581 bp, Homo sapiens
  misc_feature (1)...(1581): n = A,T,C or G
cgttnnannnnnntngaaaaaccccccntttttgggggnaaaaaannccccccccncnnnnnnnnnnnnnnnnnnnnnnnnnnnnnnnnnnnnnnnnnnnnnnnnnnnnnnnnnnnnnnnnnnnnnnnnnnnnnnggnnngnnnnnnnnnnnnnnnnnnnnnnnnnnnnttttttnnnnnnnnntttttttttttttttttttnnngnnnnnnnnnnnnnnnnnnnnnnnnnnnnnnnnnnnnnnnnnnggggnnnnnnngnnnnnnnnnnnnnnnnnnnnnnnnnnnnnnnnnnnnnnnttttttttttnnnnnnnnnnngnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnngnnnnnnnnnnnnnnnnnnnnnnnnnnnnnnngnnnnnnnnnnnnnnnnnnnnnnnnnnnnnnnnnngnnnnnnnnnnnnnnnnnnnnnnnnnnnnnnnnnngnnnnnnnnngnngnnnnnnnnnnnnnnnnnnnngnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnngnnnnnnnnnnnnnnnngnnnnnnnnnngnnnnnnnnnnnnnnnnngnnnnnnnnnnnnnnnnnnnnnnnnnnnnnnnnnnnnnnnnnnnnnnnnnnnnnnnnnnnnnnnnnnnnnngnnngnnnnnnnnnnnnnnnnnnnnnnnnngnnnnnnnnnnnnnngnnnnnnnnnnnnnnnnnnnngngngnnnnnnnnnnnnnnnnnnnnnnnnnnnnnnnnnnnnnnngnnnnnnnnnnnnnnnnnnnngnngnnnnnnnnnnnnnnnnnnnnnnngnnnnnnnnnnnnnnnnnnngnnnnngnnnnnnnnnnnnnnnnnnnnnnnnnnnngnnnnnnnnnnnnnnnnnnnnngnnnnnnngnnnnnnnnnnnnnnnnnnngggnnnnnnnnnnnnnnnnngngnnnnngngnnnnnnnnnnnnnnnnnnnnnnnnnngnnnnngnnnngngnnnnnnnnnnnnnnnnnnnnnnnnnnnnnnnngnnnnnnnnnnnnnnngnnnnnnnnngnnnnnnnnnnnnnnnnnnnnnnnnnnnnnnnnnnnnnnnnnngnnnnnnnnnnnngnnnnnnnnnnnnnnnnnnnnnnnnnnngnnngngnnnnnnnnnnnnnnnnnnnnnnngnnnnnnnnnngnnnnnnnnnnnnngnnnnnnngnnnnnnnnnnnnnnnnnnngnnnnnccgn

SEQ ID NO: 2510 - DNA, 786 bp, Homo sapiens
  misc_feature (1)...(786): n = A,T,C or G
nntttacacctngtgctgtcggccaggggaggtcaaggctgcagtggactgagattgcaccactgcactccagcctggataacagagtnnaatcttgtctttaaaaaaaaaagnatgactcancagatggaggancctcccatttggtctttcctttccgtttggtttgtcttccaaatctcctccagcctgctgngtattcctcagcaactcacttcaagcaccaccctgatcctgtagatgaaccctgcataactttctccgtcaacaaacacctgaggatctgctgtgtccccagtactaggggtgattataaaacatatatgcagtctctgcactcatgtttcccacagagaaagtactcattcagcaaagttttctaagtacctgtaatgtgcaaggcactgtgccnagtctgaagtcatggagactgtcatggtcactgcccatagagcacttaccttatattgagggagggggcagaacttaagctaataattcaatacttatttgcttcataatcatnagctgctgngaggggaaaagtcacatgacaagtgacctagtgcagangatgtaacctgggtctaanggggatnattanaaangntttccttaacgggagtttcgaaaaccagcctggggccaacacgggnngaaacccccgtttttnagttaaantccnaaaaaaaaaaaaaaatttnccccgggggggggggggnggnccccctgnaattcccaantccnccaagaagggttaaggcaaagannaaattttttcaanct

SEQ ID NO: 2511 - DNA, 1526 bp, Homo sapiens
  misc_feature (1)...(1526): n = A,T,C or G
cccccncccccccccacacacncacacggangnananngnaaangaaagncannacnccnannnnnacnnangcngaancagcctcgaanncngagangaaaganacacagnccagagacgtnagngnagaagngnnntttacntttngcgacaccgcacacgcnngngncgngggnaagacncngcgcacnacncgncatcnngcnaacgcacgngncgnagngnacgcggnccgacgacngngcnacganggagcacganngaangacggaggacgncngangacnnnagannnnacgnnggngccgcagcacnccnccaccngcnncangaannacggnaccgcacgacangacgcgacgggnacacagcanacnngcggaacgcncngagaacgnaacgncacntacngacgannacnagccaagcgacgangannacnngnangcccancacgacaggggngncgcgaaaggnanancacaancncgnaaganngncccgaaaccaaaaacgcgcnnncggncgnngacgcgaggnanncacggcnnanggcgnangcnnggagacgagcganagngnaaanagaacgngnaaaaaannnacgcgcgngagcnangcaacagacngcggntaaanagncgncgcgcnngangcnaacggncganaccgacnnancagccgcnngcgacncagcacngancccnccagggcctccgcgaccganacanangnaaacgannangagacgagacacatacancgccgagctacnccgcncanncgnacanagaggccncangncncacacnagcngagatgccagcgccgnagccnnngcttcgaggagagncgccgnacgnngcngnagagcaaggcacgnagacanangcgncgaccanagacgacgcgcatacgangnanggaggnccgagggnaganggaaatnnangagcaacncgngcangggcgagggacgcaccgganggcaaanagangangagnnacgncncnananncgnatnnncnnatcncagannancgcaccnncgacanacataggacnggnacnacngcccngncncgagnncacagagaatgnacccagcgantagcangnaaaaacctcaatgcaanacacgacacgcgacgtngcgcgcgaacaaacgcgcgacagnncnacgaacgaganaggagagaanancacgcganaccgngagatgcggaacgcgcagagacgatcatacacgnncggaggnctngcaacgtaaccgcacncgangnnnncggcanncgnncnananannngngcggntnnaagnnncgnacgcnncngnganccncggncgcgtagngacgcgnaatnannnaangacncgcaggancaanganacgcancacaancaancagacgngagcncgcannagagcacaganacgnanngagggnagaacaaggagcgacacgnagnganntaanggacanaanacaangaacgtancgacgcnaggnnnaggnnnnccg

SEQ ID NO: 2512 - DNA, 864 bp, Homo sapiens
  misc_feature (1)...(864): n = A,T,C or G
ntantcctttcgaantccgttgctgtcggcccgctctctgtaaagtgtttgcttgtgccaaaagggaaataagtggccgtgggagggtggtggtggttntccntgggcantccggganccgaaggccgaactggtccctggcgtngggtaagccccttcggcccgggggangtggangggcccaccaacccaaangtcaagtttccctttcccaccctggtggttttcttggtttccggnttttttttttccttttttttcctaatataatatttttgggngggaattctattttattttnaattctctttttctcctccaaacacaatggcactgcttatctccgaaatggngtgatcgtntcctcattgagcaacggntgccaccgccctgtgggtagtgtgtgaccgtggctgtactgtatagtgaacatagttggcatatctttgtttgaagtttgttggtgactccccaaactggtgtgaaaaaagaaaaaagctcaaaaaaatccncaaaaagacaaaacncncaaaaaaatcctgcctatattttactcagtttcaaactttattaagtctatttttaattataaaacccagaaagctacaattttcttttntttcccctccaccccccccccacccatttggtgggcttttttggttttttaaatggccanaaactgttggaggtngggttttttttggggtttggggnttttgggtttttgggttttgggnttttttacccngaaaaaaangnaagggncccaaggggattaaanggnggggaaacccgggccccctnggggggccnccccncaaaacttaaaggggcagnaaaacttnccccttaccctngggg

SEQ ID NO: 2513 - DNA, 1484 bp, Homo sapiens
  misc_feature (1)...(1484): n = A,T,C or G
ccnncngcgncnatgccancnnagnaanannncnatangggncnnganaaggaggncgcgggncgacggnnnnggcgngncanngnatnnnnnnnnnnagaatnaccgngccttccaannccngctgnanaaagcaaccnnggngcccccannacnngggnggnggggggggggggntttttcccttttnancncacnnnnccngcgaagnggnngggggggangtanaaaggnacngacaactatnggnngcgattggtangaggaanagnngcnnnnggnncngggagnnnggcggcgagagcngcggnaggnaggncgcgcgnaagngnggacgangnanggaaggnaggagggaaggcacgnacgggaggacgngcgngngngaggtacggaacgcnacgtggcgnggcgncgcanngggatggnntnggaaggnaaagntanggaangganangaagggatnngatggagggngcgngcaccgnnagagagangtcgnnnacggaaaagacncgtaacgagggacacgganaggngacngnnnnnnagggntcggaaaggnaangaacgnncancacgnnnacgnaanngaagcgnagggaacgtgaagggacgggcanggnagtnagnggaagggagacggagacgaangcacgnacnngcgnnggancggnaggntaacgtancgcacgtanatggnnggganggnaagtgtaggnaaaggcnggcgagtatangagnggnnagggtgaggancganaggtaggnaangatagnacggcngggnngngngncnnngangntatgacgcggnggaagngangcancnaagncnngnnanggaanganggagngaagggacngcggcnagngcggcaaggnnncacnaggngcggaggtacngnagngngantgcnacgnagtgtacggatgacngnnnggangnagtggaaggnaggnaggaggcnaggcngtgagagggaagcgagcacngngggtnggaanggngcggangaaggctngcanggangngagcgtaggcnggcaanggagggccggacgcaagcgcangaatngnngaggancntgcgtgccactgngnngcgcgtangggagagngatgnacggnagnaaangtnngcagggaanggnacngaatggncagcatggnatgaaangagcgnanncgagngcagcannggnncgatgcgnncggancgacgaganngagnctgcgnagcgnngnncggnggaggngnggnnggagagnagggaaggnatgggnggaangnanggtacgacangnacggaggcacggtgcgataggacggntnggacngaacggtacgantgcagggcgggtgnggacgnctgagcgaagggatcgcngtagncgangcacngacancangcgggggagngacggntnnantncgngangcacgggacgatngnaggaagganacgacgcgaggncccg

SEQ ID NO: 2514 - DNA, 768 bp, Homo sapiens
  misc_feature (1)...(768): n = A,T,C or G
tctcnntcgantccgtgctgtcggaaaattgggactgagctagagaaagaagggatcttaaaaccttgctagagaaagagacctgattccatcttcaagacatttgaaaccaaagacatttgaactggaactaaaaggttcaactcagataaactcctagttagattgaagagatatattcttcactctactcttggcaggaaacaaagcactttctctgggagaaaatattttcttctttagtatccttttatattcaatgtttagcaaaaataaaaattttgagagacttgaggagaggaaaatgggatccgtaatcaagagaaacaatagtgtaaataaactcatcaataacccagatgtttgaattaacagacaaaaaaaaaacttatgttaaagaatttagaagaaaagatggtcaaaactggtaagaaggtagcaaatttcagcagagaaatggaaactaaaaaactaaatgaaaattctagaacaaaaagtctatgaagaattaattggttggacttattggagtcaggtcagtaaaaataatatgcaaacagaagcncggaagtagaatgagaaaagagcctcagagacctgtggggcacattaaatggtctaacatgcctgtgactggaatctcagganaaaanaaatggggccaaaacaaaatctggnnnnnnaaaannnnnnnnnnnnnnnnnnnnnnnnnnnnnnnnnnnnnnnnnnnnnnnnnnnntnatttnggggnggggttttttttaaann

SEQ ID NO: 2515 - DNA, 759 bp, Homo sapiens
  misc_feature (1)...(759): n = A,T,C or G
tctctncgcgccaggattttccagtcaaaagcatattcgagggactaaaaggacatcaagagggatacttcagtcaaatgataatcagctatgaaaaaataccttcttacagaaaaagtaaatctcttactccacatcaaagaattcataatacagagaaatcctatgtttgtaaggaatgtgggaaggcttgcagtcatggctcaaaacttgttcaacatgagagaactcatacagctgaaaaacactttgaatgtaaagaatgtgggaagaattatttaagtgcctatcaactcaatgtgcatcagagatttcatactggtgagaaaccctatgagtgtaaggaatgtgggaagacctttagctggggatcaagccttgttaaacatgagagaattcacactggtgagaaaccctatgaatgtaaagaatgtgggaaggcctttagtcgtggctatcaccttacccaacatcagaaaattcatattggtgtgaaatcttataaatgtaaggaatgtgggaaggccttttttggggctcaagccttgctaaacatgagataattcatacaggtgagaaaccttataaatgtaaagaatgtgggaangccttcagtcgtggctatcaacttactcagcatcagaaaatncatacttggtnagaaacccttatgaatgtnaaatattgttggnaangctttttgtttggggctttcaacnttactcgacatcagatntttcattnctgggngagaaancc

SEQ ID NO: 2516 - DNA, 746 bp, Homo sapiens
  misc_feature (1)...(746): n = A,T,C or G
tgtannnagcncttgggatgcnatgaaattcagtataaaattgaatagaagtaatgttaatggataatcttgtcttattcctggtctcntagaggaagtttttaaatatttaatatgaaatacattgtttgattgggtttatttgcaaaaatcctttatcagatttattaagttccctttgttttttaatttattatgttttttaaaaatcatgaataggcattgaatttatcacatattttctgttattgaatggataatatggatttttatccttttattaatagcatgcattatattggntgatttgttaatgataaaccaatcttgcattcttggaataaactcaggttgcttatgatgtataatccttctttatatcattagacttagtttcctaacattttctttacagtttttaaatatatgtttatgatagaaacgccgtttctacagaaaaaaataattatttttaaaggcataagttattgggtctagacttagtacctgaatgatgaaataatcggtccacaaacccctgtgacatgagtttgcgttataacaaacctgcccatgtcccctgaacttaaaaggtaagaagccacacacncccncacagatgccccaccccacacacgcccaaagaaattggcttttaactttccattcttataagctctancngagttggcatcaaggctatnctggctttatatagaaggtaaanaaggggtactttntttatt

SEQ ID NO: 2517 - DNA, 727 bp, Homo sapiens
  misc_feature (1)...(727): n = A,T,C or G
ttactttncgantttcgttgctgtcgcgcagaccatggcagcccgcccgacggttcgctcttcgacaaccccaggacgttctccagacgtcccccagcccaggcgagtcggcaagcaaaggctacgaaaagaaaataccaagcgtccagtgaggctcccccagcgaaacggaggaacgaaacttcatttctcccagccaagaaaactagtgttaaagaaactcagaggacttttaaggggaacgcacaaaaaatgttttctccaaagaagcattcggttagcacaagtgatagaaaccaggaggagagacagtgcattaagacttcatcactgtttaaaaacaaccctgacattccagaactccacagacctgtggtaaagcaggtgcaagaaaaagtgtttacttcagctgcttttcatgagctgggcctccacccacatttaatttccacaataaataccggtcttaaaaatgtctagtatgaccagtgttcagaagcaaagtattcctgtgttgctggaangcaganatgctctcgtgagatcccagacnggctcaggtaaaactcttgcctattgcatcctgtggtccagtccttcaacatggatcaaaaatcangtttactgtatcacatttacaaganacagagcttaggaagtaataccaagcntgcccagtatggaggactggttntnctagtctgttgntganaacaactcttntttn

SEQ ID NO: 2518 - DNA, 1451 bp, Homo sapiens
  misc_feature (1)...(1451): n = A,T,C or G
acnancngcggnngcgngggcngnnnnnnnngncnnancnanncncanncgcgncggcggagcggcacgngggccgcanggccgngngngnnnnagcgacgccnagncggaannacnnnnnnnnnnnnnnnnggtcgcngnccgngnnccccgnntcgaannncgngangacgggcgacgncgcctnggcccccccgcccgcgagggggcggggggggggtttttncaggngncncgnggccnngnggggngnnncgggggangcgngggangcnangnngagcggggacancagggnaggcngagngcggggcggacgnggcnnccgnngncgnncngganncgnaggggngnnggggacaacncnccccgnnggggnnancnccggggcgccgnnanccacgnanncgncagggngggcgccccggggcnngngccngngggnnggggncgcgnngnggagcgggcgaangcgggncgcccgnncggcnccgggcgagnncccnccgggnncccccgngagagccgncgccnancncgnccgacgagcggncgncggnangnacncgcgngcagnngngacganaacccngngcggcncncaggcggcgccgcggcncccgggcgangcgggngnngcccggacnncggcanggagcgcgncgcncggnannncnncngacggggcgncgcgccnggcgngnagcnanacncngngtnggcaangcgcgcgngngnccgcncaaganggcgcncagnngngcgcgncgganngcggcgngcagggacggacgcgncagcncggcgacgcngtncnncacccncggcgcggggngcgcgcacgngnctagaacgcacncgngggacggggngggngcgccnacggncgccccgtnncgacgcacnncccgccgancnnaccggcngnggcncgncgcagnanangngnngccgcgangnacagggggagangacggcggccggnaaggccntnncngaggacganngcacacgcacggganagggangngcgnngcgncggngnggnngcnnngggnggnacnccgcgcccgnanangggaagngcgnncccgncgcgaggctnancgacgnnncgngggggnggntcgacgcgcgggggnggcatnggncccgcnnatngaagcncgngnnagcgccgcccaggcgnacgggnangggnaacngncgngggcaacgaatggngngcgggaannggcnacgnacnnctgtgcgcnagcgnggngccgccncnagcntnagccgggggacgngacnnagggcacgggngacccgggacantnangaagngncgcnggncggncaggcacnggggngcgcngnggncgaagnngngcgaaanggnacggacgngcgagggacangggtcngcggnaaagnngggnagcggncggnncngggcggnggcnccg

SEQ ID NO: 2519 - DNA, 1459 bp, Homo sapiens
  misc_feature (1)...(1459): n = A,T,C or G
cggnnnngngggnnnggngggnnggggnnnnngnnggnnggggggnggggggnnnnggnnnnnngnnnnnggnngnngnnnnngngnngnnngnnnnnnggnnnnnngnncgggngggngngnngnncnnngngnngnnngggggngngngngnngngnnngnnnngcnnngngngngnnnggnnggnnggngcnngnnnnnnnnggnnngnnnnnnnnnnnnnggggcgnntgaaccctttgggnaacncccnnnannnccnnggtggngcncnggngnccggcncccnccgagntngnnnggggggggggggggggggnnttttttngttncgggcnnccggnccnnnnggggggnntgggggcnggggggnnggggggggnctttttncctnngggngggnngggggggngngcggcnggcggaggngcgggncgangacggctgtggnggggnnggngctnggnggcgagnngntnnggggnggggnggngcngggacggcgtgcgggcnggncnaggggggggggngnggannngnggncgtcnnggcggntnnnggggggngggggggnggggtcnctcganggcngncgggggngntgcncgggggctggncgggggnggntgggggggggcnggcgngnggnnggangggggggtntnnggccgggggggggggngnangggncgntcnnnngnngggnccgangggngaangntggngggggnnccgngngnnnngnggnnngggggggggngnggggnngnanacngggannggngcacnggggggncnnnncgcngnncgcggggtgagaggggtncggnnacggggggggngggangngtgggggngcagcnnncggngngtnggngncgccgcnnngggcnnnngngngngggggggncggacncgncggcggcgaanggngnggggagatgngngggtgncggncnggggnggnncggcgnnnnngnggngngncccccnggggngnggngggggaggtgagcgaaangtgggggncgctggggggngcnnatacgggggggggggggggggggnngggggggggnntgnnggggcnncgnncgnggnggggnnggggggncnggncnggggnnggcgggggnnggnnngacnggggngctngggagggggggnnggcnnggggngggnnngtagggnncggggtgcgnagnaggggcgncgnnngctagggggngncgnnaaggggggcggggagngacngngagggatgnggggggggnggngngnggnngngcggacngnggggngccngggaggagcggacataggnaagggggggacgtngcgcggnagngntgggncggggggnggtgggaacgngggggcgncnnccggtgggggggggganggctcggngngacgtgcgggatgcgggcgcnggancaacgngngnggtgcngnncg

SEQ ID NO: 2520 - DNA, 757 bp, Homo sapiens
  misc_feature (1)...(757): n = A,T,C or G
agnntntncgaccntntcgantccgngctgtcgnnnntgtgnangctacctgtnggaacntgnncaatgnncanncnnacatgngtnggntgnctaccgcacaggaaatgacnttctncgatgcatgnttnanccatgcgcggtggattctgctagatttccctaccttatggctgaaaaacttggcattcatcccagcagctgccatggatggattttgggggaacatggcgactcaagtgtggctgtgtggagtggtgtgaatgtggcaggtgtttctctccaggaattgaatccagaaatgggaactgacaatgatagtgaaaattggaaggaagtgcataagatggtggttgaaagtgcctatgaagtcatcaagctaaaaggatataccaactgggctattggattaaagtgtggcttgatcttattgaatccatgttgaaaaatctatccaggattcatcccgtgtcaacaatggtaaaggggatgtatggcattgagaatgaagtcttcctgaccttccatgtatnctcaatgcccggggattaaccagccgttatcaaccagaagctaaaggatgatgangttgctcaactcaagaaaagtgcagataccctgtgggacatncagaaggacctaaaaaacctgtgactaagtgagctctagcttgtagaaatttaaaaactacaatgtgattaactcgagcctttaattttcatccatgtacatggatcacagttgnttttgatctttt

SEQ ID NO: 2521 - DNA, 1178 bp, Homo sapiens
  misc_feature (1)...(1178): n = A,T,C or G
nnnnnnnnnnnngnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnncctatcnncntagnacncccnttttttgggaaaccccccnnnnnnnnnnnnnnnnnnnnnnnnnnnnnnngnnnnnnnnnntnnnngnngnggnngncgnngngggttttnnnnnnttttttttttttnnnnnnnnnnnnngnngnnnnnnnggngggnnnggnttnngggnnnnnnnnnnnntttttttnnnngnnnnnnnnnnngnnnnnnnnnnnnnngnnnngnngnnnnnnnnnnnnannnngnnngnnnnnnnnnagnnnngnnngganggngnnnnnnngnnngnngnnnnnngnncggnnnnnnnngnnnnnnnngngnnnnnnngnnnnngngnnnnngngnnngnngnnnnnggnnnnngnnnnnngcggnagnnnngnnggnnnnnannnnnnnngngnnnannngnnnnnnnnngngnngnnnnnnnnnngangnngnnnngnncngnnnnngangggnngngnnnngagnngcannnnnnangannngnnnnnnnngnnnngannnngnggnnnnngnngnnnnnnnnnngnanannnnnnnnnnnngngannnngnnnnnnnnnnnnngnngnngnaagnnnnnnnnnncnnnnnnnnnngnnnagnnngnnnnnnngncngngnnnnnnnnnngnnnnnnannnnnngnngngannnggnngcnnnnnggnnnnnnngnnngnnannnnnngnngngtgngnnngnngngnnnnnnnnnnnnnnnnngnnnannnangngangngnngnnngngnnngnnnnngngannngagnnannanncnngnanagcnnnnngnnngnnnnnnnngnngnnnnnnnnnnngnnnnncnnnnnnnnnnnnnnnanngnggngnnnnnnggnnnngnnngnngnngngnnnnngngnnnnnnangnnannnnnnnnnnnannnnnnnnnnannnncnnnnngngnnagannnggnnngnnnnnngnnannnnngnnannnnnnnannnnnnnnnnngnnngnnnggganggngtnnnnnangnnnncnnnnnngcnngngnnngnnnntcagnnnnnnnncncgg

SEQ ID NO: 2522 - DNA, 813 bp, Homo sapiens
  misc_feature (1)...(813): n = A,T,C or G
atntnttacccctttcgantccgttgctgtcggtttatatccaggatccgtgcctttccaccgggtgtggtgggcccagaggcagcccaangagtggtgctcttctgtccagatgagccttggtgcccagaatggaaaagaaatcaggcatcggcctaagaggaactgaaagcacccccaactctttccagggccctcattttgaatagaattctctctgggtggcagcagactcagctctgggacattttgcctccacctggaccttggaggctgacagtggggagggctgggcctagaggaagagcagaaatggggaatatttggaagcggaggctgctggacacagagacctcctgttgggggtagtacgtggagacagaaccctgcttctgggcatcctggggtagtactcacaggggcagggggcccangcatcttgccagagccaaaaataatgagccaangctcacatccctgcagttggcttctcaatcaccgttcagtaccttctatgacccccaagtacaaggtggnccttaaccatttgtcaaatgcattncactnttcttcctttttcccaatttctaaangggttctttgggaagttccatcttgaacctgtggttttcaactttggaaccgaaaatgttttaaggaaatttngggccaaggaaaaaaactacttccnttcattgggtaagccctttgaatgggaaagggttttttcttgaaaccaagtngattttaaaaatccccattggggggnggggtttccccaaaaaaacccttncntttttnatttaaaccttt

SEQ ID NO: 2523 - DNA, 1619 bp, Homo sapiens
  misc_feature (1)...(1619): n = A,T,C or G
cnccccccacccncccngaccccnnacnnangggannannnnaannnnnnnncnncngnnngnnnncgcnnaannnnncnaacnangnaaccgnnnancnngnnnnnnnncnnnnagnanaggnaanaggaggangccggncngcanncncgnnnnccngnagcgcngcgcagccggacnngngaggnnccnngcgnngcggaanccacngcgcnangcggancgnacnngngnngaacncaccncncnnnncncnncnntcgggatacnggaaaaccctttngngaaaaancccnnccangnnngacacaagaagncncacaccangacccccnnncccancngcngcnancagcgngngngggccaattcnaccccntcnccnaagagcncaacgncgccagnncncaacnggcncagnacccngnaggancaannacganaaaanngnacgccgngcacagcanncgnacgnnncacgcncnngncgaccncccgcnggggnngganannccacgncgcgacgnaagccgnccgcgacggcacnacgaccgccnccacgncccgacgnaggcggaagcacgccgcccgngangacanncngnagnngcgngncngagcgcanacgnnacncnangcanaccngancngagcacnacgcggcncacccnncccgnagnnncaaaacncnncaccnaggancncgcnancccgcgcncccngcgnccgacgncgcanngnagnacnccgcgaccaagcgnccgcngcgangaacgnnagcaacgaangcggcgcnngcgnncgcgnngancnaacggacgcacgcgcnacagcngcgngnagacggaccnggnngacaccncagnncgcncncgagacnncgccnngccggcgaacgaccncgcccggnnngggcacgccacaacgngcgcnccnacgaccnggcncnannnannnaagcaggaccgcagagaacgnaacgncagacacgacanacancgagggngaccacgcacagccgngcancnnagcnacngngcgncaancacacgcggacgnncgncgcgaggcnacgctngngnacngaacnaaacgggaccgcggggacgncannacacgannncgcacgcgngcgncgacncggcncggnangcgagacaacgaaagcgncgnnanngcaacncnacgcncccaaagcacacgnaanggcncaggagnggccnanaaannganacctgcgcacgngngcgcaccgagacgagcacgcgagacggccngcngagggnaagcgagacgccaacaggcgcgccgacgagcggnccncagncggaaccgnagnaacccggggacgnncgncgncgcgangcgcacgcnnnaccgagacgcaccgaancacaccgacgacgcatcgcgnagccaaaacganaagggngggcnaccggacaggnaanggancgaacagcnacgccaccgnacgnnacgcaccgcacgggcaggcncgggacganacannnnaangnagncanncgcgcgacgggaaacgcncgcgtacgcagnngnaaancgnnancgcacngcgnccgggnacacgncccgcaacgnanacggacgngncgccn

SEQ ID NO: 2524 - DNA, 756 bp, Homo sapiens
  misc_feature (1)...(756): n = A,T,C or G
nttttaccntcgnttcganccgttgctgtcgaatctgtaaacctttatgacattaggaactaagaaaacttagtcccttcgttagggggataatgaaatgtatttagtgtttgtgaaacatagatgggtatgtatttgggacaattctgtaactttgctttttttatttttatttttccatagcttattggggaacagggtggtgtttgggttacatgattaaagttctttagtgggtgatttgtgggattttggtggacccatcacccaagcagtgtacactgcaccctatttgtaatcttttatccctcgcccccctcccaccatgcctcccgtctaccatgatgatcctgttttaaataagaaaataccatttcgcaggctccagatgttctggcatcctccctgtggatttcccagtgcctgcagctcacaggacaacaggggctgtggtagagtcacctatgagatcctggagtagtggatggaggagatggaacagtgaagacggaaactgagctcagtatccgggtgccaggagacaaaggccctttgctttttttcatttaatattctgatctacccctgttgacacatgttaaagtatagtcattttgactgctatgtattatgttccattggggggaacatactggaattgtcacttcaatctatactggatctcctgggtgtatttaaaaggtttngtttttttaagtagttgggtatttccaactnaaacctcaaaaaactttt

SEQ ID NO: 2525 - DNA, 740 bp, Homo sapiens
  misc_feature (1)...(740): n = A,T,C or G
tntntncgcctntcgcgatnccgttgctgtcggagaaaccaaacaggtaaaagcaagtggtgaagccacatggattaatgagatgatagaaagtacaaaatcactatgtaagtcagattaaaaagccagcttgcactctctgctttcatctttttgaagcaataactattacataaatcagtgaatacagtatttctacagtatttgaaacggtgttcacacccagcaattccacttctagacatatatccaagagaatggaaaacatgtgcacacaggcacttgtacatgaatatttatggaagcattattcacaatagccaaaaagtggaaacagtccaaatggccatcaagatgaatgaataaataaaatgtagtgtgtgcatgcagtggaatattatttgcccataaaaagaaatgaagcactgatgcaggctgcaacatggatgaacttgaaagctttatgctacgtgaaagaagccagtcataaaaggtcacctactgttattcctttcataggaaatatccagataggcaagtccatagagacagagaggagaggagtggttgccaggggctgggcaaggagaatgagagtgaccgctatgggtgtggcatttctttgtgaggnaatgaaaatgtctgtttagatagtggtgatcattgcacactctgtgatgtctaaaatcattgattgtcacttgaagaatatttagttgtattattctagttaaaaaaat

SEQ ID NO: 2526 - DNA, 722 bp, Homo sapiens
  misc_feature (1)...(722): n = A,T,C or G
gagggctatgtccatgcggncctcaaacnacgtaacatattgtggagtgcagagaatgaatgttttaaactcattgactttggacttancttcaaagaaggcaatcaggatgtaaagtatattcagacagacgggtatcgggctccagaacagaattgcaaaattgcttggcccangctggcctgcagagtgatacagaatgtacctcagctgttgatctgtggagcctaggaatcattttactggaaatgttctcaggaatgaaactgaaacatacagtcagatctcaggaatggaaggcaaacagtttctgctattatttgatcacatatttgccagtaaaagcaantggtgaatgccgcaattccagcctatcacctaanagaccttatcaaaagcatgcttcatgatgatcccaagcaggaagaatttctnctgaaatggcattggtgcancccattctttagcnattccttttgcccctcatattgaagatctgntcatgctttccactccagtggctaagactgctgaatgtgctgggntgatgattatcttgagaatgaaagaaggattatgaagatgttgttgaagatgntaaaagaagaagtggcaaaaatnttggaccagngggattctntacttggtnccaaaaggaaaaatccttggcannaagganaangtctttggttgagtattgccaaatgctggnggatttccct

SEQ ID NO: 2527 - DNA, 1163 bp, Homo sapiens
  misc_feature (1)...(1163): n = A,T,C or G
gggnnggggnnnggnggggnannnnggnnncaannanangngnnnnnnnannnnnnanggnaanggnngggggngggnaangaaaannnnnnngcnnaanccnnaggggggagaagnannnnnnanggggnannaaanncgncnggancnggnanggnnaaannnngaangggngngnggannncgcanaaggncnacggannggganagggnnnnggannnnnnncaannngangggaganncgnnnnaanccannnnnnnnngnnnnntcgnnanccnnaaagccccttncgggnaaagnncnggggggggggancaaggganggacggaccgcngcacagaggccaccaccanacncgacccnnaggggagggaaggggacgccnntnnnttcccangcnggaagaggancgcgncgcanngggggngggagggggananaggngcnnggnnagcncacngnnagacggngcnngngggaggacgcgaggnagacacngncgaganagncaggcgcgcagagcnaggaagcgcnccggggggggagcaggcgaanaggcagcnnaagggnccatcggagagnggncgccaggcgacnncggcgcncggcnnagnncnnngnangananagccgangancggnncccgncancgncgagcacaggnngagcgggcgannggngnngaacgnngcgnggcacgggggcncaggananggagggaccgcangaccangnnagagcnnggnggcaggggggcnngganaancacnggnaaagncccggcgggaagggnanccnccggngggnnccnccnnnnccgngngngggggngcnnnggcngggnggncgncnncgggnncgccnnnnngcacggaccgccacacgnggacgagagggcnagcgggggccgnaggngccgngnngccannaagacagagcgncgggangananggacancgggagagnaggggcgnggnncgcncacgngcggngacggnggagngagacggggagnngncnanncanagcngaaggggngcgggncganngggnnnacnccggngangagnaancnnnggggcncgnnncgcngngaaannngggagnaccgngnaggcanangancgnannnnaagaaaggngaananaccccccncc

SEQ ID NO: 2528 - DNA, 1347 bp, Homo sapiens
  misc_feature (1)...(1347): n = A,T,C or G
nnngnnanannnnnnnnnnnaaanngnnnnnnnnnnnngnnnnnnnnnnnnnannnnnnnnnnnnnngcnnnnnnnnnannnnnnnnnannannnggnnnnnnnncnnnncnnnnnngnnnnnngnnngnnnagnnncngnnnanngnnannnnnngngngannggnnnnngnnnnnnnnnnnncgnnngnnannnannngcnannanannnnnnnnnnnnngnnnnnnnnnntccntaatcctnnaaaaacccctttttggggaaaaaancccccnnnannnnnnnnngnnnngnnagggaancnncnnngcncgcnnnttnnntnnnnnngngngcgcnnatnnannngcgnnnnatnnccncgttttttttttttcnnnncgngnannngangnannaggaggagggnnnngtttagagnngngcnnanngagaacnttttnnacnannccganncncgnacgngcngngnaananngngngacngnacngncnaganngncnganangacncggangacagnnacncannnnggangnncngacngnncnnagnagagancgngcagggacaagcnggggcgcggannanangcgacggnnnnagcncccancanacnancgngnnnnngcagnaanngnncgagacgnnagaganaagagngacngagcnnngtcanncggcgnangnngnacnnggngnggnnaggcgcgacgcgagnangagannncgaangacganggnnnnnngcgaggnnggagacnacgnannnnnnagnnnagcgngcangaannaggnncgngannangaaggaancggcgagnannnnaccgancgannaangannganacgnngcnngncaagnanggtngnanangnnnnggganggcangcanggnnangnaanngganngnanncgnaaggcnngcngnannanngcnangcacnngnacngnnangacaaanganancgnaagggaaacggggagcggnaagcggnaacnaagcggcgngnngcacaangncnnnggcgnngcanangngacgngnncgnnacnagnnnngacgnngaangcangacnaacgngnnnggaaagggnngagnannnnanggcaacgnnnnnggnncgnnnagncanggnancggaacgngaangnanangnagggcaananacgcgnaancnangnnncgcacggcnacgcancgnnngcnnannnnngcgnccnngngaacgnangnanacgcaaanancgnnggggancgangtntcgacngngnagncagnangnagggacngannnatgganngangnacggangganngaancncagacgngcg

SEQ ID NO: 2529 - DNA, 1126 bp, Homo sapiens
  misc_feature (1)...(1126): n = A,T,C or G
gnncgcnggnngngngnnnggnggnggnggnnggngnnngnnnngnnnngngnnnaggggnngnnnggnannnnnngnnnnnngcgngggnggnnnggnnnngannncggggggnnngtnnngggcngganggnnngnnggngggngnaggngcngnnngnnngnnngnnnnnnnnnnnnnnngnatntgntttttnggaccttggggnagncnggcngngnggggcnggagnggcgtngggnggcgnnngncnnggggggggcgnggggnactttnntnggggttttaggcngccgcnggnncgcgggggggggangcgnagggnggngggngcggtgggngggngtagccgngggngagaggnggaggcgggnagggnggngngggnnngcgagaggcaaccggntgaagacgaggcaggggantggcngnggncgcgngnngggcgcngcgccgcntgtcnggggggagggggnggnnggcagggnggcgccgggggggggcgggggnnggggangngngggangaaggcncggggggggncgagcttganngggcggngngggaatggcgnnctggggaggccgnngttgnnggagcgnncggggcgaggggggagctgngaggggggggcggangcggcgnngannggagngngggnggggggnnntncgangangggagggcggggangaggncggntagaanggnatngccgggtggggcaggggngggangangggngtcgggtnagggnggtgggggggggaggngngggggnncncnnggntggaggggnngnnnnnnnngaggggngggngacnanggggnnnaggggggagaaggnggggtagccggggnannncgcggcggcggattggncggagganagggngggagggggntggagggggngngggnggcggcnccatgnnggggngggggtngggagggncngngaggaggngggnngggggggntgcannagctangngggagatcggggngncgnnngtgangngacggganggtgnnagnganagngtgngngnggcngagcggggtgnngatngctnagcgnaggagcgcgcgtgtnnagnacggcggaaggnnggcgggggagcg

SEQ ID NO: 2530 - DNA, 989 bp, Homo sapiens
  misc_feature (1)...(989): n = A,T,C or G
gnnnnngnnnnnnnnnnngnnnngnnnnnnnnnnnnnnnnngnnnnnggggnnggnnggngnnngnnnnggggngngggnnnnnnnngnnngnnngggnnnggnnngnnnnnggnnngnnngnnnngnnnnnnnnnnnnnnnnnnnnnnnnnnnnnnnntggnngntcgngagacccttnggggngnncccgggcngncggccnggngccngcgcgggcnggggnggggngggngcanggncaggcggggcngctgcggggtcctgccccnccnncngaggacncggnccnncgggnncngcggcgngnnccagggcgngnggggcngngaccngggccncgacnncnccngggannccngcgcnagcggcggggncnncnggcgggacagngcgcnggcngncnngnggccnngggacanagagacggngccncggnngccccngcgccgnggggnggagcccnggggnngnnccnncagaccncccngggnngngggacnggggnccccnggnggggnggggaccaaggancccggccggcncgggngggggggccagccncccnncgggcngnggcgcgggggggcccgnggncgggcgnngccnccnnngcccnggcccnggncccnnngcggggncccnngggcnggnggggggnggaagcagnngncnnnccgncgancgnngggggggncgngggnnnagggggnggnngggggcncnnccnggggggggncgnnngggnggggggggggananggcnngggnggcggnnggggcccaggnnnncgggcggnggnccnnggggccnnccccnncngaggggnanggnccnnggggggggagggggnggnggnccnngnggnncgnggngggncgggnggggccncngganacgnnggggggnnggccgggggccccngccngggnggggggnanaagcnnnngnnggggggngggggggggggccncccccncnccccngcg

SEQ ID NO: 2531 - DNA, 751 bp, Homo sapiens
  misc_feature (1)...(751): n = A,T,C or G
ttaatcttaccccttncgantccgtgctgtcgcttgtacagtatttctactttttattctaatcaactggactgttgcattatttttatgtagattgctaacaaggtttttgaagaaacactcttaaaagtcataaaagggaaaatcttgacagttctgggatattgccacccttgaccttttggagaaatgtagacagcatctcccaggcatgacgcctagggatcgtgtttatctgtcatcagttggtgactccatgtttattgagcactggctataagccagacttggtgagggactgaaacaattacaagacacagttctgcactggaagaaataggaatcaacctaagatttcctgtcctgctaggtcatcaggttcctgtcccactactttccttcctctaccaaattcacttatagcctccaagtagtgtaactatcaatagcacccctttcactccccaaagtgtcctaatttggagagtaagttgtatgatcaccctacctacagtctgcctgttttccaatgcacactttgtctctcccctgctcttgttacatgtgtgtcctgaggccactttccagatggtcttcctctgtcattactccagcatgtcantgctttgctcaaaaactgctaactggggtcttcattgngggtaaataatccattttcttatatcatgtagccnaaagctctnttccaatttggaaatactaanagtaactcctattcatgaacaggacn

SEQ ID NO: 2532 - DNA, 708 bp, Homo sapiens
  misc_feature (1)...(708): n = A,T,C or G
nctccaaaaatttgcttgatcttgggtcttgttcagggcagaaagagataatacaaggctttggtgatgcttagcattttagaagaagtaatgctgggtgggaaatggatttggcagtctcgtttttcgcatcattggaatgggagtccctcacagttggagacaggatgaagtaacagagcgtggggatctggattaacaggtggccattcgcagaaaggaggctgcaaagcaagaggtgggggcttctggctgagcaggaagtgggagaggggcatccttgtgaggagcacctgtagtgctggggtttgggcacaggcaggcagaggactttatctgatcatctcaaataattttgcctctgcttggaagggttctagctacaaaggcaacatagcaggtagtgcttgggtgtgatggtgataggcacagcggtattttaaatactggtggtacattttangaaaaagaangtgacgagtncctggggaaagtcccttgtggtggcccatgactcacccgtggccccaaggggaccagaaccagaaccaagggaagaattccatcaaccgaatgggaaacctttgtcttttttaagggggaccaaggaaanctttttttttgtgttgggttgggccctggtnggcnttattgaaggaagaaggtggaacanttttnaaacnaaaaaccccanggccccnttttttt

SEQ ID NO: 2533 - DNA, 1199 bp, Homo sapiens
  misc_feature (1)...(1199): n = A,T,C or G
gaatagtgtaaaaaacccccaaanttnttnnaatttccgngaaaanatttcccccggttnttgggcnttgggttnccganaaaaaaaaantttttccncccaagnttattccanccccccnctttacgagcntnggtgggttttnctttnccaannggannatgggaacnccggnagnnnngngngctantaataaattannatacnatnnnnagttntggannataatatanannaacnannnattacggnggagtanttttnttactatnaanancaaatntgtnacantactnaatattgananatgtnataaattaaatagaacaatattnnnattntaaaaggaanaaaatatnattananatnaanagnnngaagtanaataataanataattnnntatnattctatggaatanaattanaatataactnaatnnttntaananganncttacaatctctntgtntatatnanaanaatcgaaaattattacttactanatataaantatntantcatnntnnaaatnntaatatanatatcnttacaatanatnattattaataacttaaanaaacananctcntatantttnatancnanataatacananaanatttgattnataatnanatannnaattaatttataatatatanttatcnannataaaannatntatnanattntnnanaaatatangnanaantacttatatcnanaaatanttaaaanaaatatcnactantaatagaactacatttatttanatcattcatnnanttttcatagananntatnaaatcntattattnacanntnatttaatttanatntaaacttatantatnntctacnnataactannttaaaatnatatnnanttattnanataatanatatctantataaatananntanataataaatttaatnttactnantatatatattnataagctnttnntatatatagatnatangaacnnantnatattnnattanaanataannanatatgtatatatanatcttacntntttcatatataatntntnttnacatatatnaatntatctatctanttcatcaatactattnnatacaattataaacattatnctnnatttnnnnaaatatatattatnantaantntntctctannntatanataantatanaannttttnt

SEQ ID NO: 2534 - DNA, 709 bp, Homo sapiens
  misc_feature (1)...(709): n = A,T,C or G
naaccncgntcgantccttgctgtcgaaaagaacttaaaacgttcccacaggcccntaaaagtcttgtgagttctggcattgtggttcacacatcagatgcccaagttggccctggtccgcagcagaggagggctttgatgggacttagggtatcacaggtgtgctctggctgttgtggggaacagactgtaggcagccagtgtggaagtgcagggacctggaaggggttgactgcactggccctggaaggccctggtaagaggtggtgaggttgaaaataaggttgggggggccgggcgcggtggctcacacctgtaatcccagcactttgggaggccgaggcaggcagatcacgaggtcaggagatggagaccatcctggctaacacggtgaaaccctgactctacaaaaatacaaaaaatttagccaggcgtggtggcgagcatctgtagtcccagttactcgggaggctgaggcaggagaatggcgtgaacccggaaggcggagcttgcagtgacctgagatggcgccactgcattccacctgggcaacaaaatgagactncgtctcaaaaaaaaaaaaaggaaaaaaaaggaaaaaaaaaaaaaaaanntntntnnggccntttttttcntantccccaantttnaaaaaaanttttgtnggatttngcncacccncccctttantnntnnnnnnnnnnnnnnn

SEQ ID NO: 2535 - DNA, 746 bp, Homo sapiens
  misc_feature (1)...(746): n = A,T,C or G
naaccacgatcgantccgtgctgtcggtttggtttatatataatgagggaagaagatgattacattatttttgtcactttgccatcattgtttagaagtcatagaaagaatttttaaataggccaataagtcttaaacttgagtacttggcttagaagaaagtcaaaactccttcctttttgactaagtggtttgtttctggggagctcttaatttctatttttataatcattagcctataaggaaattgtgtcttccttgttctcagggtgatctgctgaccttgttcactcatgaagcatttgggtatcatacttatagtgtctgaaacataaactgtattgagctagacaaggtatagcctcctcttcaagtagcaaatactatcaaaagctataatgcagtaggagcaaggtggtccttgttccagtttttgtctcagttctgctgctgatgtaccatgatcttgggaaggtggtgtctcagtgtggagatctgacacattgttaccgtgcctcctggctggagggacttggagaacaatgcagttaagtagaatgggttttaaccaatacagagaaaatttattccattttaaaataaaaaatctggattttttaagaaccttttaaaaagcttttggtaccagtggtaaaataagaatttaaatggtattttaaacatgccttttatcaagccnccaaaatnaaagggatttttaaaaatttttgtccnaaaaaaattaa

SEQ ID NO: 2536 - DNA, 708 bp, Homo sapiens
  misc_feature (1)...(708): n = A,T,C or G
naccacgatcgaattccgttgctgtcgcaatttctgagtctctttctatttaatgccaccaatttctgaggaactagagtgcagagtggattgcttttcagctttttctattaggattcagatagctttttaattgctgctaatatatttgtcattcatattgcttttttgttttcaaaattcagttaatattttttcttctcattcattttgactttgtaggttcatgccatttgtaaaaccctctttgttgtctttttattggaattttgagagggagttaaatgtctgtttttaatctaccatctttaaaccaaaattccagctatttaatttcagcatgaagaattgcattaaaaacagagcagtgaatcattttatgaataataatgctggattttatttttaaaaattatcctagcctaaaatgtttaggatcatcatagcattaagagagatttatatttggtaagaaatcaaaaacatcgtcagttttcatgcttaaagtatttaggatcataatagcattaagaaagatttatatttggtaaaaaatcaaaaacatggtcagttttctagtggaaatttttcatggcactataaatctttagtaacaagattttctatggttagnctttggatatctttttttttcttaacagtagtttataaaaaggatnaaaagctgncatanggctgggcccagng

SEQ ID NO: 2537 - DNA, 710 bp, Homo sapiens
  misc_feature (1)...(710): n = A,T,C or G
tcctcgntcgantccgttgctgtcgcaatttctgagtctctttctatttaatgccaccaatttctgaggaactagagtgcagagtggattgcttttcagctttttctattaggattcagatagctttttaattgctgctaatatatttgtcattcatattgcttttttgttttcaaaattcagttaatattttttcttctcattcattttgactttgtaggttcatgccatttgtaaaaccctctttgttgtctttttattggaattttgagagggagttaaatgtctgtttttaatctaccatctttaaaccaaaattccagctatttaatttcagcatgaagaattgcattaaaaacagagcagtgaatcattttatgaataataatgctggattttatttttaaaaattatcctagcctaaaatgtttaggatcatcatagcattaagagagatttatatttggtaagaaatcaaaaacatcgtcagttttcatgcttaaagtatttaggatcataatagcattaagaaagatttatatttggtaaaaaatcaaaaacatggtcagttttctagtggaaatttttcatggcactataaatctttagtaaccaagattttctatggttaggctttggatatctttttttttcttaaacngtagtttataaaaaggatnaaaagctgncatagggctgtgcacagnggg

SEQ ID NO: 2538 - DNA, 1565 bp, Homo sapiens
  misc_feature (1)...(1565): n = A,T,C or G
caattccataannntnnanntacanatctanatatntntgntnngnnanttnttatatattgantaantntatnnatantctttnanggtgaanactntcatgtcagctnnaanaattttannttntagngggcanntcatatattatggtatctgatannantgnnatnntncctntgnnnnnnnnnnnnnnnnnnanaccnngtatcgantccgtngctgtnantataantnncngnntnccccctcgttgangtgtaaattatnatatagnggttnncactttatattctttttttcattatattctttactcttttctannannactgtnttttntttnttaanatnaatgacntantctcctantatcnanctntaanaannnnatcatantatganntnanntaannnttanttataatanganttttattntnantnntntntnattttantatgnattncatntatnnnnctttttgatgataanccttnaanatatattntntatantacttcaanntntatnatcttnntnttatanantattatatatttgtattatnctntntaactantantttncttantaantatnattnatancncatntaatttatatttcncactnntttntancnatcatagttanattntantagtactatcatntgtaatntatttattattttgatatnnnacttnntntatagtatnntatgtntatatataantnatatactattttttatnagttacattatatatnangtaatnttatnnttnatngtaatntnctaaaatatatttcgatttnntcaannttnatntnacgttatagtanttacnatcntatgtaangatatacgagttaatanaannaaanataaaatcacaantangtanntaatagntaantatnattctatanatntatnaaaatctntatatatatntnattgactanntaatcgnatatattatctnncgctattnnannatcgtnctntnagtctttnaatnttncttanaatancanntnnanaactgtnanctgttnatatatnntntanntctatcatnntnttatctttctcgtataaanttaaatnatatttatcngtntgnntannntataaanttntattaatcataaacttatactnatcntttatactcctattgacattncntaaatatnntanttaatnatnagctacaantatctaagctanattntattgtatanatttanatagtntatttntantctgttataagtttaactattantgtatgtgtctgncacgtcatntcaattnntctaatactntatctntntnaantattatgtgtntgaagntatctttatgtatanntgtatananantnactatnatntntatangtaatatannttantcnaagnaatantgatanttctatntnctntacatnttnantatntatnttnttcttctcnccataangttcatanntttagttacnntatnagtacaatcnttaacgtatacgatcttatctctncacacgnntgatnn

SEQ ID NO: 2539 - DNA, 723 bp, Homo sapiens
  misc_feature (1)...(723): n = A,T,C or G
naccncgatcgantccgtgctgtcggcaaaatagtattttctattactgtgcaggggaaagggatggatcgatacatgcaaatttaatgtagtaactcacttttccatatattttgaatgtatatttctatttatgataccaatttataaaaaataattacacagaaaaaatggaataggaaaaattatgcatctagcacatttaaactgtgcaaatatgaaaatttttcgaggattacattttatctgaaggctgcatattttaactggctttaaaactgtaacacatcacataaaagatactttaccaggtatgtattgcattatatcattgcaataattattggaagtctagatatcgagccatcccaggtgttgggcggggggagggttgtggcaagattgtcttttcaattttggagagttttcctgtggctacaaggcaagtaacgggttggaaaaagtctgactgtaagccgttggacaccttcatagtgtagtgttttagtgactttttttatacgggtcttgtaaattaaaatcnttgtaatgggtgtttcaaaaatggtttgtttatgcactaattcagacaacttttcctggtacttggtcttgataaagtgaaaactgcaggggaaataaaaaaatncntntcaaaaccttaaannannannnnnnnnnnnnnnnnnnnnnnnnnnnnnnnnnnnnnnnnnnnnnnnnnct

SEQ ID NO: 2540 - DNA, 733 bp, Homo sapiens
  misc_feature (1)...(733): n = A,T,C or G
tnaccttnntcgaatccgttgctgtcgggaacactaatggccctccctggaacagacacggcgcccccccacagaatagcctcgatgccccctggaacagcctcggtgccccctggaacagcctcggtgccccctggaacagcctggtgctcctggaacagacacagcccccccagaacagacacagcaccccctggaacagcctggcgcttcctggaatggccacatccccccatcctttctgtgctgctttaggcatctgcccttacgtggttcgtgtccagctctgtcaacaaggccagctccacaagaggccccagctcagccctccccagtgggctcccctactcaggctctgggtcagcttcttcccaggaggtgtcctggcccctgtgctggccccgcctcgctgcctggacacctgtccgtgccaccctggtcactgagcaggacatccgcgtctgtggcccctgggaccctgcccccgacagccaggcctgggtttgtccttttaggtagagtgcctggtccaggtcattggaggagaagtccacatggccacctctggcgtgttctaaaaaggccctcccgcgcttgggtcaggaggccagcatcggggaacaaggaaaaangggggcttgagcttcctggttccttttcttnccttccccgaaggncaaanaaacatttcccattccgaatgtccaatggcgcttaccagaattcnttccnt

SEQ ID NO: 2541 - DNA, 708 bp, Homo sapiens
  misc_feature (1)...(708): n = A,T,C or G
naccacgatcgantccgtngctgtcggcctgggaagatatatgtctgattttcggacttggaagcaagataaaggaaagaggctgctggtttatggtatagagattttcactcgttaagaaagtaacaaagtaaggaagtaggattattgtagaaatattattttacagttcaagtttgtaaaacacaggtgaaggtaatcgttggtgggtctcttcctctgagatcaccaaattatctgtagactggttggtagacttggagagaccacttgttcttggacaacagttagaagcatactgccctaagcagtaaaaaggtgattgttgagggcagcaagaggcggtgtaacataccagttcatttttcttttcttagcaagcatgtactaattgccttttaaaactcctgaccataggggataaaacgattacaagaaagataccttccctgctcccatggaatttacattctagcacaacagtggatattaaacaacgtatcatctggttatgtaattacagtaataagaatcatgtaggagaggtcaaggaagcttactgctgtggggttcaggatggcatctncgaaagtatgaataaggaaagtggtgggagaataaaaggagagtggcagagactcaaactgagagattaattgagataatgacaattgngggattcaatgaggtgttaatgtgttagncctg

SEQ ID NO: 2542 - DNA, 718 bp, Homo sapiens
  misc_feature (1)...(718): n = A,T,C or G
tnaccnntnttcgaattccgttgctgtcgtggaggcttactaaccaggtaagccttctatgcatccacaccaaaatcctgcagaatgtaagtaagctctgctttataagatgggttcaccttcatcgcagactgaaagtttcagtttttatttttttcagaaagcacgaaaaattatttataatagtctggagaaaaaacacactgtaatatttcaagtgtatgcagtagaatgtactgtaactgagccctttcccacatgtctaggctccaatgtctcctgtaggtccacctaactgtgtgttttcagggacaatgccatccatgtttgtgctgtagacttgctgctgctgaatcctttctggggactttctcatcgggcagggagcagagggcttctcgttcatgcaccctttgcctgaacacccatgtagctgctgtgttgtgtatatattactcttaagaggagtgtgtgtgtctgtgtttgttttaaaagtcacttatttcttacagtgatttcaattgcaccatgacttcttcactaaaaccacaaagtcctgcttaaaactatggaaaacctaacctgattagagccttgactatttttgaagaataaatgcncacttttntnttttnaanattnttggaaattgagacttttggggccntttttttngggggaatttctaacctgntaanaaacnttnnanaattttgan

SEQ ID NO: 2543 - DNA, 889 bp, Homo sapiens
  misc_feature (1)...(889): n = A,T,C or G
annattnnntnnaannnntanananttnnnttnnnnanntntnntannnntnttnnttnntananatnttnntttnnngggganagtanntntntntctatnntctntactatnntntantnctggnggngnttnttgnagatntatntnctatcttnnnnnntnatnantannnnnnnnnngaataaaccnnntatcgantccgtnngctgtcngntggnctgaccaccccactcatccccgttaacattctctctaaagagcctcgttcatttccaaagcagttaaggaatgggaaccanagtgttttaggacctgaagaatctttatgactctctctctttcactctttttttttttgccactaagtnaaaagcgaagngagagtattaacgtttttgttctcctccggccccntgttncaatnaaggggcaaaagtatttgctctnagtctattcctcccttaacttctgtgactaattttnatttcctttctanattngcccaattaanactagggtgcagngtatcctgnataggtagggtnagtgggggaggaatcccttggggnagatattaggantgctctgttgtttacaaactcaggtncccgcagggcctancaaagagacttaaatgactgataaaaaacccntgaaaaacatgtttgnttccaggnttnatttcantttttccnnttttttttttttnnaaaaaaaaatntcnttttgtcaccngntngaangcattgggncnatnntcnctttnttntaacctccctnttngggntaaannaatttcttttgccnatcncccnaaatcttanataaangccnttccnncncccctgttnnttttntntttaaaaaaaantgggnntcccntttn

SEQ ID NO: 2544 - DNA, 746 bp, Homo sapiens
  misc_feature (1)...(746): n = A,T,C or G
gaccacgatcgantccgtggctgtcntnnnaccgnccccncccacctgcntncagctgcctcttncacctgggccctgctctcagatggaagtgtcaccaaacacccagatcgtcgtgctcctgcttctctggagtggacacaacctgaaaaccaactggactgagcatccttctcctaaaatctcagccagaagccacgatggagggtcctgggaagggaagagatgtgaagatttctgtgattctaaaaccttgggtctgcctgcaaacttctctctgatcccagccgagagctgtgcacacgctagctagccctgtcacacaatagcccagtgttcccgtcacaantgcctgggaatgagaggcttttgagccacagagctatgacaagtccncaggttgaattgactctgggaggacaaatttctgagagactcacgggacccttatccaggacaacctcacaaaagatcccttgaaactgagctttctctgcttncgtgcataatttgaggtataaactttncttgtgtctncggtcaanatgaagtgaaaggatgaatattatccccaaggctaaaagntaacgnaaaangtccaataagccatccgatgannagaatatnttnttttggaaagaaagncttgtgaancatttttccattcaaacccctggtnangttttcccnaaagaanttttttccccgaanaatattgtngtttnggcccatnaaaaacactggat

SEQ ID NO: 2545 - DNA, 716 bp, Homo sapiens
  misc_feature (1)...(716): n = A,T,C or G
naccnnnntcgaacccgtggctgtcangctgaaaggcctacncattaaaaactaacactgcctcccctgnagggagatagtcctttcattttagctccttgcattgaaatagcattgaggattaaatttgtgtaagccccacaaaattcaaaatttatgtgcttttctgaccacttgccttctagtggaaattttaagcatattagaggatatgtttctgtgggagctgatcagaatggtactaggagtacaaaagaatatctaaaactaaaacacagctatatttcagatcatactgcttcatcacatcgagtgcatctacaaaggtaataaatagtatgtggctgagttagggcttgggaccattttctagaagatttgccctttctgcaattctagtctctataatgattggagtgtaggagttaagttgtggagcgtctcataaatttaactagaatcatcccctcttaaaatctaaatcaaatattgacatattagtcggccattatttgattacatttttattggtttaagcagtgagagatgttttgtgcagaatctggttgttttcacccctaaagtaaggcattgcattatttctaaataatcctataaagcccctaaattaaaaaaatttaaaaccaacccacttttntaaatgaanggcnctnctagntttctatggggccagcctctcattcccggnaatttcn

SEQ ID NO: 2546 - DNA, 717 bp, Homo sapiens
  misc_feature (1)...(717): n = A,T,C or G
tnaccncgntcgantccgtgctgtcgctgnctatcagtgtaccggatatttatgtaaactatgactgtgacttaaatgctgccaatatatttgaaagactagtaaatgatctatcaaaaattgctcaaggaaggggcagtcaagaacttggtatgagtaatgttcaggaattgagcctgaggaaaaaaggtttagaatgcttagtgtcgattttgaagtgtatggttgaatggagtaaggatcagtatgtgaatcccaactcccagacaactcttggtcaggaaaaaccctcagagcaagagatgagtgaaatcaaacaccctgagacaataaacagatacggaagtttaaattccctggagtcaacatcatcatcaggaataggcagctacagtacacagatgtctggcactgataatccagaacaatttgaggtcctaaagcaacaaaaagaaataatagaacaagggatagatttatttaataagaaaccaaagagaggaatacagtacctccaagaacaagggatgcttggcaccacacctgaagatattgcccaattcttacatcaagaggaaagattagactctactcaagtgggtgagttcctgggagataatgataaatttaacaaaagaagtcttgtntgcattttgtgggaccaaccatgactttttcaggaaaagacttcntttcagcccttcgtatgtttctaga

SEQ ID NO: 2547 - DNA, 680 bp, Homo sapiens
  misc_feature (1)...(680): n = A,T,C or G
atttcattgccctctttanananttgnttncaaatgtcgagcatctttatttatccaaatctctccacagtgtttgtttaaaggggagcgctggagagtaaactaaatcttacaatgagcatatggatggctataattgctgaggtttgtttttttttttcatatttgctaactcgctatatataaaattgngtttctattttatanatttcacaccctgaanactgctaatttttgcatgcatatgattttcacatgaatggatgaaaatactaaaatctcttccccctggaattgtctaattgccccgaccctactctaacagcagctagtgggtgggggcggtgganactcctgccattctctgtggcaccccacttccctggaagctcantcggcctccgtctgctcacgtattggcacggttgtcttccaaacccattgatgccggaacatgggtcaggaanaacacagtcagctctctggngctttccatancgttcctttttgccaggcttctganatttttaaataacggaagcaacatctgccctntgaattaactgacaatggggaaacacacattgcaaaaattatcttaatgtntagcaaatcaagggaaaacaaactttgcttaaccattggtttcagctttctatccaccaaanccccaacttttt

SEQ ID NO: 2548 - DNA, 721 bp, Homo sapiens
  misc_feature (1)...(721): n = A,T,C or G
tgaccattnttcgaattccgtgctgtcnaatntgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaagccatctggctgctgtgcacangcgctcgtgaggcttgctttcngaacattaagaccattgcttgantgcctggcanatgaacctcatcaatgcttgccaanggctcctcgaactcctatgccattaaaaaanaaaggacnagcttggaancgtttnggccaaattccaacccgttgattttnccanctggttgnccnaataaaacttttnt

SEQ ID NO: 2549 - DNA, 703 bp, Homo sapiens
  misc_feature (1)...(703): n = A,T,C or G
taaccacgatcgantccgtgctgtcggtttggtcttaggctaaaatccatgttntacggagaattcaagaaatttttaaacttcaggtagaactgtgttttttacaaatgtatagaaagcatagtgcctaatgcatggtagaaacatttctttaaggatgaccggatgttgccgtatgtatttatggcacaagcaggtgttgtctaagcagtttctctgtttgcttgtcatagcagcatttggaaactcaaacatgctttcatttacataaatagtttatgaagctttgacaacaaatgtaaacagacacgaaattataaatctgctaaatatgtattaagggtattaattattgaaagtccctttccccaaaactcaactcctatggcaattatgaactccattttaccaagaacatttaagtgcctcagcatctgtatgatatagtggagcaggtgctgacataggtaccagctgacatgatgtgtcactagctctgtgggatgattgccacatacatggaacacctgggagtgctggaaatgtactgggatcgaagtgacaaagtgtgttttcattcacagtggaggctacatcaagcaaggggaggnccaccctcttgcaagtgtggtgagangctctctacaaagacatgggcaccggagtaggnccctgtancatgcnggtgctgtananaaaatnt

SEQ ID NO: 2550 - DNA, 1063 bp, Homo sapiens
  misc_feature (1)...(1063): n = A,T,C or G
ctccntttnnacgtntnacntagtnananntgtngnntnnngttanattgttaggtntntcntgctctcncnagatnnctattacnatatanngttntntatntacnggnanntnctanacnttctatctcttnnanacttnnntntnncnnnnanaagaaccangatcgantccgggctgtcnntctncgcagtgtacnccctgccttggatcccctcccctcaaggagttcatctcngcgggagggagggagacangatagganagggnacttttaantggtctntancccttagcgagggngtgttgaggtcatgcatgggaggaggctgtcttgnngcngaaccgggttcanggaggctcatnngnganngntnccctcctaggcactggagttntggcttganttgtgaggggtagccnaanggnnnggctacaatgnncgngggnnggagagtntnctnttntcggnggnaacnagannntnacgccncncatgnagggggtnttcatgtctttcangttccagggaatattatncatnggttaanacggnggnttgcnngntgnaatcgaatntactcttgctccnntgttttnacntntntttcgagantnngggaantgnanntctcattgcctggggnntnnactncntggntantgganntntcaatcangcangnngctttnnnttggngatggggnncttcttnngnnngnttngactctgatantaancnnggnnntcgnnctgnnttnctgnattacntacncnantgngttggatntgnnanctaannntcnnnantnatgnaaccncnacttnnntntntcnccgnnaaatggaacantncanntgnttgtnncanctnnngtaggnagctngattatagtatncntnttgtgcnanttntnacctttgggntntggnactnntcttcncgattccttatccacanaggggactcccantggtnaanataannanacgnggnagcttnggngnntancatngggngtttttnctctntcaagtacnaantntnacacctctntncg

SEQ ID NO: 2551 - DNA, 715 bp, Homo sapiens
  misc_feature (1)...(715): n = A,T,C or G
gaccncgatcgaattccgtgctgtcggnttagcactcacatatttttgttcaatctttacttctcacacaaacagaaaaaggaaattatatattctgtatcaacaaagatttaacaaaacatccatacactacaactgtctacttactaaaattaagaattagtatattatcttttttcttcttatattaaaactatcttttcatacactattttaagtttatgaactgaaagtcttttagagataatttacttcaatgaactattattatttatattttataagcaaattgtcacaacttggtattagctagctctactgttcgcttacagtctctaaagtttctgaaagcatccatgatttctgccacaaagaagatacttaggaacgattctgttttcctactctgtgacctaaaattgactggttcttcaatggaaatgagatccatatcgggcactaagggtatacagaaataattgtgggcaaaagtactaaagctatttttgttgcactatattttgagatctctttaaggctctgtgttcttactgatttattccaatttaatgtattgnactattggcatcctactttttctttttaaatatattattattgactgnttacaagactttgtgttaaactgacaggaaagtttttataaaccaataacagcactcacattttggaaagactgggtnccattggtctn

SEQ ID NO: 2552 - DNA, 713 bp, Homo sapiens
  misc_feature (1)...(713): n = A,T,C or G
tgccttatcgantccgtgctgtcgnnctgacgtgaaatgtaaactantaggcgtgttattgatctgctaaaactaaccctctttttaagaggagatttaaggaagacgtcaatcaaaatgtcaaatatgtgtgtcagaatataaataatttttcacattgtattgttgctatataaaaaaaataatagaattggttgggtttctgaggtgaaatccagagtaagagtactagacagttcaacaagccacatctaatggcacagatagaggatgtagctattttatacctttcataacatttgagagtaagatatccttcaggatgtgaagtgattattaagtactcatacctgaaatctgttgtcaagattagaactggggttcatgttaaaaaccttccatattacctgagggtacctgtggggaacagttccttcccctgtgtggtagtattttgttggaagagaatgtttatacaaaaaatgaaattcttccaacagcagagaaactctaaaaagtttgatagtacctatcaaagtgctgtacttctgtgatagagaacatctgatgtacccaattttagatctattttctttatactttttctaatcaattgcttaatagtactttggatgattatcacctttgccactttaaaatatataaatatcctttttacttcatgaggaaggaagaatttttggntaatactn

SEQ ID NO: 2553 - DNA, 1506 bp, Homo sapiens
  misc_feature (1)...(1506): n = A,T,C or G
ccncccctcacnctgtnctcaccccnannnggncttgttctanngntgntgantttnnagctttntattnaggantncttnnnntaattctntntctngagtgganntnnnnnacggtacntcaaaancntgggtnaattcnnccttannncccccatnnnggttttcttnntttnatnnctnatnattctantcnntntnctancaatnttcctnatannntcntnngnctctnttttaatnnatanacttacctnactcnanttctctanctngtatatntatnnngaggnatcngntacggntnactanagctnnnanatnactggtaccncctacncntncncngctatntaacgtaatgacctcttaccntactataccatntnnctcttatnaaaacgtataatatnctaacgctatatatggctacngcaacgnacacgcancntatcnctaagctgaactnactntgnntanncgcgtantgtaatngtnagtntangtcanatattaggtnatgcctcgngtattnannnttaatcaattcnattctatannntctgntnantntnctnatatnttatcccnatcatattnnntatnttatcaaanttcatgtgtcntntctactnaacttangtatantnnatgcgacgcnnngtntatcanngncantttctnttaacttngcatatnctctnantntaatgntgtatgcnacnntatntattctnacgaacntnatataatnttcntaanttntnatcantnnatntatngtactacatngtcnntngtcaacncgtatatctctnntttagnanatntnctatatncaatntgaatgctgnttancnctcnctntagcnaaaaaacgctactatatcancgtntcntannnttaccttcgttctcnacgtatntacgatacgtaatntnactaccttagctancancgtcncgntgntacncnaanctaatctctanatnntctgcatgttctgcatntagacnatcacntacntnnntanattntacgntaantatctcatnctcnttnnatnnnaacgngncagctntntnacnttcnacncnngtntntannnnacattatnttnnatctcagnaaaatctattacnttcnntctatacttngtatntantatatctcatcttagnngntanatgaattatcnngtncnctatnaannacacanactantntanntanangaccgtannnacntnnnattcngtacatatnantattntntnttatngatntntnnctcaantgggatanatactacntnttgtatctnncgcatntatnctangntgaatacnntatntnnatacctngaangtacgcncacnanctaatntanctatgcgancnanatnncgctacgttntntcactctagccnantaatantncgtanatatctacntgatnaantantgcncttaacntacntannntgacangaacnnatntncg

SEQ ID NO: 2554 - DNA, 707 bp, Homo sapiens
  misc_feature (1)...(707): n = A,T,C or G
gccacgatcgantccgtgctgtcgcactgaatgacttaaggctcgacaaatgatattcttggaaagtttaatcttgaggttttcaaatctttttttttaatgtctcccatgtttctcatttgctgattgattcattagttgctcttagtaagatttgtcagttggaaataatgaaggctgagactcatttctaaactcttccataaccatcaccagaagagcagccactgtgttgtgtgatgtaggctaatgcctcccagatagaggtaaagtcacaaggactattagaattccagtggattgtggaactggttttggattatccttatattttcattctgattactgaggcagttctgaaaactcctaccattgaaatagtggtgtgtcttttccttgtttaaggattttacatcatttttatgcacttgaattccaaaatcagaatctctcttttacctatcaacctttattggctattggcttttggcaatgacctttctgttcaaatgtagtcctgtctctttgtttccttagggagtagaacctgcctttttctcatctttcatttttttgacgtgtcctttctaagaaaangctctctgccgctgttctgggtgataaatgatattttcatctaatcgntatgtgggttgggatgatcatggngaaaaactaggaagacatctctggtggatggacttttt

SEQ ID NO: 2555 - DNA, 1192 bp, Homo sapiens
  misc_feature (1)...(1192): n = A,T,C or G
tcnnncnnnncnagnannaatangnntttatngtantnantatangtagtgtnnaggtgnnnnananagtgatanngttcnagnntnncannngtntgncatgatnatatatagntnnnnnnnngnagncatgatcnaatccgggctgtnntntgcctgtggncccnatgggncanacactgngcccgcccacagaatagcctcnatgccccctggaacagcctcggtgngggcctgttcagtctcngtgcncnctnanncatcctnnantancntttgaanagagnnatttagagtanaaannaantttgtcacttnntttntcattaaaaattactatnngnaaccttangaagnnnatgncnnatcaangcnnntgtcnagctatgaagaattatntntangnggaaanaacatnaantttnacatncnnagtnattcccaatngaanccctaaanaacatgnaatttggtanggnttnnctacnntantgtcnnatggaacncnanactnaanaaaaggtatntttnaatnnctcctnggnggtatcngggannctaaacnttgggngcgcgcntatganaatatagagcntatcntnatngaanacntatgaatgtatncntctgcttatgtnnantcgtattatnactnngnatattanatnaatnntncnnnttnntanntagatcntatgagtcaaacttgntattaagntatnantactnatatannnganncatcnagaannncntncacananaatattcacncgtgncnctatatnatccgangannantaanntaagttnnanncnatntaantcaangtntaattnnnttnnatatttnggtnnnngatttnnnnantngtatgtganttattattacangacngannaatnctntattgnnttnnngaanntttatnaataatatatctannantnntnttatancatnnntnngtntncatntntntnnngtnanagcgnnggnttcatntaagcnantnttntntccaacgannangagntncnannttattnantatacattntntagntnctnacttntaanatctcnnaattgatnangtanatgatnntattntaaatctntnattnntcananttntactctattananncancctannntnatnnantncatntacatcnncngatacg

SEQ ID NO: 2556 - DNA, 710 bp, Homo sapiens
  misc_feature (1)...(710): n = A,T,C or G
nacctcgntcgantcttgctgtcgcccggatgaagaggtgagctccccttcgccccctcagcgagcccagcgtggggaccactcttcccgggagcaaggccacgcccctgggggcacttctcaggccagacagattgatttcccgctgcggatcctggtccccacccagtttgttggtgccatcatcggaaaggagggcttgaccataaagaacatcactaagcagacccagtcccgggtagatatccatagaaaagagaactctggagctgcagagaagcctgtcaccatccatgccaccccagaggggacttctgaagcatgccgcatgattcttgaaatcatgcagaaagaggcagatgagaccaaactagccgaagagattcctctgaaaatcttggcacacaatggcttggttggaagactgattggaaaagaaggcagaaatttgaagaaaattgaacatgaaacagggaccaagataacaatctcatctttgcaggatttgagcatatacaacccggaaagaaccatcactgtgaagggcacagttgaggcctgtgccagtgctgagatagagattatgaagaaactgcgtgaggcctttgaaaatgatatgctggctgttaacgtaaagtccctaatgctttcttctncgctgggtttcactaggctaaaaatcttgccattcagctnatgaggaatgcctt

SEQ ID NO: 2557 - DNA, 721 bp, Homo sapiens
  misc_feature (1)...(721): n = A,T,C or G
taccnngntcgantccgtgctgtcggaaaatattagctactcaaataagtaggcttctgaaatagttttaactgcaagtgtgttaacttgtgtggtggtttgaagccatttttccaaataaagttattaaacaccactttatgtactgaagcatgaacagaaaaatcaagagctgagcagaccacctcctttatgtaggcaaaacttccatcattttggcttttgttctaaacagaactaaatgacatgcatagcatggtaacttacagatcgcttaattggagtaaaactcagagtaatagagggaaatatgggctcttcagtgcctttttagcttttttgagttgaagacgttcctacagatgtagtttaaacattacaaagtaggcttctttatccaaaaatcccaatgtgtcatagtacacagatagtttaaaatatgtagcccggggaaggggaggcatgtaaatgtcttgaagaggagaaaaagtatgaaagaagatcgatagttaccaataatgtgtatgatgaggacatactttaaaaatgtaattcctctgtacagtaaattaccaaatctttagggatttttttgtaataagaagaatttatatttgtaatgggtctaaagaattttttttgtaatgngggattataanaattttaatttgggaaccactttataaacctggtnaagaaaaaaattntngccttctggaat

SEQ ID NO: 2558 - DNA, 736 bp, Homo sapiens
  misc_feature (1)...(736): n = A,T,C or G
tgnacctcgntcgantccgtgctgtcgggactacaggtgcccgccaccacacccggctaatctttgtattacaggatagagttcttggaagcctggcgtggagggagggagagcaggtagcacagttacagaaggatcttcgggatatggaaatgcggtatttgtggacactcattcatctaacacacatttgttgagctcctaatgtgtatagaactgaagggatggagtcatgggcagtggaaaagctgaaattgtgtaaaagagagagaaggatcagtggctatggtctcgaagatgacgtggaagtgtcagccatgacgggtggggagtggcctgctgctcctcctgggaagagaagaaggtgaagactcagggcgcgtctgcagggagacagtgggagctgtggggtcgtggatgacgctgatcctgtcattagcatctgagcgaggtcacaggcatgtggggcctcgttaacaatgcccggcatctcaacgttcggggaggtggagttcaccaacctggagacctacaagcaggtggcagaagtgaacctttggggcacagtgccggattgaccaaaatcctttcttcccctcattccgaaagggccaaaagcccgcgtcgtcaaatattcaaccaaccattgcttggggcccccattgggccaaccccgggcccgntttccccgttacttgnantcaaccaaatttcnggggttaaaaggcttttcttt

SEQ ID NO: 2559 - DNA, 1347 bp, Homo sapiens
  misc_feature (1)...(1347): n = A,T,C or G
cctngncnaantctaannanatttggnagnntgnngnaatttatgnaattggcagattangattannntttttccatttggggnatttnnngggtnttttnnttagcaatatnnnnnnnnnnntaataacacnatcnantcgngtgnttnttagccancangccccccgttgagccnttgtantttaaganatggtccnncnttttattntggaagtnntnccacacntttggntntttntgcaattnnttattntnatantantatatanntcttttttngntnttngagcatctttttacananannctctnctattaatctnnttnnanattattntannanttnaatanannatanttatgattactgtcgantnaatacacctttgtcncntnncttnnnaagctatctntcnnacantgaacactanntnctagtactaanacnttanntcagtntcttttntactngntnatagtnctngantnnnntcnacnagtanatnnnttagncntancantagatctaatganntatnttcgatnttactaggcctanncntatgatgtnttnnactaacnactttnntangnnntnatntangcttntgtaagtncntatctantnncncatanntntatntnattgaaannaatcttatctnatgaaaantatcttatgctattcctngntaacgtgtnngnaatgtatgcgtcnctatnanataggggattttatactatgtnacataatntnntagtactgntatntatataaangtanatctaacgctgtnatattcatacnnntatctatntngtcgngtagcntagcgnaaannanncgtactaanaattcgnngtntacatatatcgtatntantgnttntnnngaaacatatncgnancttaatgnacttcatnnntacgnnatgttgtctgatccttngcgcacngntacgnnnaaatcgattactaantntatnctatagtaaatgtatngtatctatatnnnatnannatctctacacgtaagngtaaanntnacnttactatgnntnttatattacnaaatctnatgcattcntaaancgnctcgtatgggtacntnaagcgatatgtnntngtatatntacgcaaacatagtatatattatncnatntttttnataacattatcatatatnatatatatttaaatncnanatnattatnataanatgtnaatgatanaatanngcanatgnaagancgnnaangnaaagnnagtnntcnctacttatnttcnngntggtatgttatagctanntatatacggcanctangnannanngaanncntgtacg

SEQ ID NO: 2560 - DNA, 759 bp, Homo sapiens
  misc_feature (1)...(759): n = A,T,C or G
aaccncgntcgaattccgtgctgtcgntananatgacatcacncgtgtangggtgaagcnnggaganctactcngntatgantaangttnnaannngaaatgngannnaantggaatttgcnaaagtgcctgccctataatgttagaactggaccagaaaataggagttggtataaaactagaccancgagctttttttccttcaagatgcagttcagtttattgcttttgtaaattagagattgtgtttcttgatctttattaaagtagaatacaatgttaacctacttcaaattttaaaaaatatacacacatgtatatgtatgtgtgtgtgtatatacacacaggattttaaggacagttttttgtgtgtgtgttgtgcatgcgcacgcatgccaaggaaattgttaatcttctagtacatcccccataacagaggcagctaccaataagatctagtctttgccttacagaccaggtggctttacctgataggctcacagacattcagtagttcatttgttcctcagatttctttaattattgnngataaagttgatatttaaatttaccaactttaaccatnttttaaatggnattantttatttggccatttaangtggtaatttcncantttgttngnggccagccnttcattggancaatcccatcntcttanggaggttntttccnttccttccntnaaattgggaaatcttttggtgcccccaaaaaacaaattancctaccccctttnt

SEQ ID NO: 2561 - DNA, 1097 bp, Homo sapiens
  misc_feature (1)...(1097): n = A,T,C or G
atttgaaccccannggnaatccgggaaatttccngtntggccttggtncnagantgacaacctcgtcggggaggtagccccccncgtattgtgagatantaaagacngncttnganacnggnagnncntggctnagggcganaggaaangattgtcatcgagttngcagtccgngaaaatggccgtnntcgtnagggctagnnnantngagagaggangtctattttntttaagagatantaataaanantnttagnnctcnntagatgtctcnatnagtaataaanantnatnnnatcnngtnntatgnnacgngcattctgtataanatagaagcntatatnntngcatannatacacagttantccatatctgtagntnaanaatnanagtnctttggangtnnttatncaanaactngngtcntnanngnnacattnantattnngaagngaacttntntaannnaaatatncanctctcacaannctnananantnananntnnaatatanatctntnannntccnnacanacnnnanatannnncnnnnctanataganaanaatataattanngtngtnactttangacanaattncgatgtcannacatntcnatcnaattattcantnctannnaactnaagnanncgtntncnanagangagnanantnaatannntattnnctangaattcattgtattncnatcactaantatnaannnggtataaaanaaatnanatcactacttattananangatnaaanatataaanngantnatattntatanntatgaaanntatnatacntattcactaannanntnnantannntaaacttntgcnnnntaaacattctnanncatgctatataaactaagatatatgaaannntaaagtanatctacgtnatnacatacacannaatcnaatnttaacttanataantatnctancttatagatctgtaaataactntatatttgcttaacnangnancagttactctanctctctantatntangnctccatattatgnacccaanntcnnnanatgtccaancatttatcttaantantgancc

SEQ ID NO: 2562 - DNA, 691 bp, Homo sapiens
  misc_feature (1)...(691): n = A,T,C or G
ncntgctgtcggttgantccnanaaaanccaaacagttgctgtcaatacaactccccttattttctctcaagtcacctggatcgtcctgaccccgggaaccccgtctgcagcaccaggccccctccgtggagaaaagatggagccggattaagcacccagtgctaaggcgactaagacgccactgcccgcaggccctgccggaaaatactcagagagtgcagcaggcgccgcgattccttagaaagtgctggcgtggcctctcctgacacagaaagccggctcctggatgcttacaaaggactggcccgcgcaacaccgttgctcctcaacccgggccacactccaaggacctctactgagcttcagcttgctcaccgaaaacggcgcggccccctctacccgggatgtcggagcccaggagaccctgagagcccccagctctttccgtaattgcaggagaaggggcaagcgggtccgtagccgggggccctccagtggcattatcctgaaccgccacgcccgcacgtggcccggctagagctccctggcgaaggatcacctgttcctacagtgacaactggacctggcccgaacccctggcatctggcaacattattaccttgtcgaaacagaagtagagattgaaatagangatgcagttccatttcttctgctgtctggaaggaatct

SEQ ID NO: 2563 - DNA, 773 bp, Homo sapiens
  misc_feature (1)...(773): n = A,T,C or G
gggctttcnatttcattnncctnntnaaacacttntctctgaanagcgtgntaggactctgcaggaagaggagaggtggtgtgagagcctggagaacnnctntcccaaacttnncnccngctttnanacagggnncancnatnnntgctnacgntcagttntntgatttttcttcnttaancaanatttactnatatgcctttnnttttgcntgggataaacncctanaagcctntgatatttgatnctgctaatctatnttcnctcttctgcttnggangacatggncactgtttccagtattttaccaatanctngacnatcaacgttttcaacnttctgancnaanatnaatnggccactgttttaacntttcanccaaacnanccatgctcatctnaagnactattgattgaagatcgtcngcttgncctnttcttcttgannaaattttcttganttggctaatatgtcccntccanacatctatnagcnaangaacttttgttnaaagaaanatttccaaancctttttcnantttncccaccttgttttaccaaggctaatttnttgaatnaacggggggaaaaaaanaaattccanaccggngtggcatttttcttttccaattttggnaaaccaccccctttntcagaaaaanttttnttttaaatttttttaccaaaatccaagggtaaaaccaaaaantttttgnctttnacccttttggttncaacnttcnttttttccccctaaaccccnccaacttttt

SEQ ID NO: 2564 - DNA, 709 bp, Homo sapiens
  misc_feature (1)...(709): n = A,T,C or G
nnaccncgntcgantccgttgctgtcgccgagtgacagagacncnatactntgattggcaatnaaatgtgaaacccannttcttgggcaagtcaaattctggaatcacatccacctaaattaaaatgactngctcgtattttccccatcttcaagtttcacatcctggtcatcaaaagactcgacagcaagacttagaatgaaaaagggtacttgtttatattaatattttttacttgaacacgtgtagcttgcagcaggttcttgatgaatgtgctttgtgtccaaaatgcctccccattgtacacaggtgtacatcatgcatgcaccaacacctaaaactcaaaactaaatggctattttgtaaggttaatactttcagttaaacagcatgtttgacttgattccatcatggtgctcttaaattacatgtcagtgcatcacatatatcatgatctaatgcagatgactaggctttttccaaaaggaagacagaccctcagacaccaaaagccaatctaaacaactcccaggtttgctgtggacaatcagcatggaatggtttctgcactctcagtcatgaccatctgtatcttgntacctgctttctctctcaacaccacagttctcaancctgaccttncagagagagctnttggatgatacaagangaatcccagggccccggatctaagatgccccttaaaaga

SEQ ID NO: 2565 - DNA, 706 bp, Homo sapiens
  misc_feature (1)...(706): n = A,T,C or G
taaccatnnttcgantccgttgctgtcggccgccgcctctncaagttcttgtggcccccgcggtgcggagtatggggcgctgatggccatggagggctactggcgcttcctggcgctgctggggtcggcactgctcgtcggcttcctgtcggtgatcttcgccctcgtctgggtcctccactaccgagaggggcttggctgggatgggagcgcactagagtttaactggcacccagtgctcatggtcaccggcttcgtcttcatccagggcatcgccatcatcgtctacagactgccgtggacctggaaatgcagcaagctcctgatgaaatccatccatgcagggttaaatgcagttgctgccattcttgcaattatctctgtggtggccgtgtttgagaaccacaatgttaacaatatagccaatatgtacagtctgcacagctgggttggactgatagctgtcatatgctatttgttacagcttctttcaggtttttcagtctttctgcttccatgggctccgctttctctccgagcatttctcatgcccatacatgtttattctggaattgtcatctttggaacagtgattgcaacagcacttatgggaatgacagaaaaactgattttttncctgagaaaacctgcatacagtacattcccgccagaagnggtttcgtaaatacncttggncttctgatcc

SEQ ID NO: 2566 - DNA, 708 bp, Homo sapiens
  misc_feature (1)...(708): n = A,T,C or G
tgaccnttnttcgantccgttgctgtcgctctccgcagtgagaacctgccttggctcccctcccctcaaggagttcatagccgtgggagggagggagacaagaactgttggagacaagaactgttagagaccagagagcaagggcgtgatgtggtctgcagggaggaggctgtctgaggcagaaccgggtcagggaggccatggtgcgggtaccctccaggcacggcatttggcctgacttttgaggggtgcccagggttggctacatggcggggcggaggtatctttagtgggggaacagcgttgtgccaccaggaggggtctctgtctcccaggtagaggaattctccatggtgagaggtggtggtgggggatggtctagctgtccactcttgccccctttcggatttggaaggaagccccatgctgggtccacactggtatggcgtattaattaggcagctgctttgtctgggagggggctttgtgtcgagtctccctgaatgagcagggctggcgacagttgtcaaaacacatggtgcttggtcagagcccccgtagaancccttgtcctccgcatggcctccnctgcacccgggcgtgggaatgtgctcttgtgtgtccctggctgtctgcttctttttacactggccccttcaaatnganggggtgggggtacangggttnctttaaaaancanacacttgg

SEQ ID NO: 2567 - DNA, 709 bp, Homo sapiens
  misc_feature (1)...(709): n = A,T,C or G
gacctcgatcgaattccgtgctgtcggtgaggagaacatggatatggatgtaatgtccttcccttttgttttctttgcacaaatttcagtggaaacatgttgccaagtcagatcgccattctacttgagtgaatatggaatttgtccagttttccaaatgcagagctttttgtgggctgatggactgaatagaaagaggaacaaccatacacccttctacagatgaaggcaagattttatgaaagcgacttcattcgttctcctctgcctggtgttccttctttgtaaaccaggaccagggagctttgaatatagcagtatattatagaatttggtttcattaaatattatacctgcccttagtgtttatattccagtatattgacaacccaggtcctctctgtacctgtgattgtctgtgttgagactattacagagctccaaaaattaaaataaaaataataattttacagaaatacatatttgcattggaatatttaagaaagttgagtttggatgccacaagattataggagtaataggaagctgggcacagtggctcacacctgtaatcctagcactttgggagggtgaggcagtgaggcaataggattgttggagcctangagtttgagaccancctgggcnacataaggagatcctgtctcttcattaagtaaatttaaaatgaattaactggtggngctgt

SEQ ID NO: 2568 - DNA, 1078 bp, Homo sapiens
  misc_feature (1)...(1078): n = A,T,C or G
agnggncgaccccccnttttttgggnggaaaaaaaaaaaaaccccccccggggggggggcccttgggtancanaacattaccctngggnnacccgnncgggncnaanaggagnnccccccnccaaangntttaaanggtggtngtggtnnatgcccnaaccaaacaanncggngaaatgnatggnccttnnaaaaacacnncaatntttttttttntcaatgggtntanatacnaagcggnaanaatcannnacagngnaacangggngggggcgccanattncntagacatngccnanctaggcaccccncctattatttcactgggaaatnncnaatcagnantatnaaccacttccgggtngccnatgataagaaaaaaaattanncnnagtncggcatggngnactatatgnatngcgnaaatncannaagtaantaagaaacnagtttttcancattnaaagctaccnctcttgnanagnaanccacangctgaatatatctgaatgntcanganaanantcagattaaatattnttggagcnnntacatagacgcatnangnnagnnaatcaccnnncaanagancnnnnaaacanacacntcaccnnnananctgacncacancnncganacanacacgnnggacagagancagnannacatcacccacacacaannnnanataancganancagatacngtcgnanacnagacctctcgtcgncgacgnnnntgatgacaccanacatgcaantgcaagananncaccaganctcnaacaaaanatggatgcaacacgcacgacgnacgnnagnnagaccctacacncntgnatgnaagatacnnntnccnnacanagntatnaacggacctagangancncgcatnntctnttanaaagcnncgaangctcccaanntcaangnagnngnganctcacntncgcataggatcnaaaancgcacggaannactagancggctagnctangnantccacgcnaataanacatnactcannngnannnnanncnnnnaccacagctatanacntgncgtaaacgtancgcgc

SEQ ID NO: 2569 - DNA, 1452 bp, Homo sapiens
  misc_feature (1)...(1452): n = A,T,C or G
ccttctnttttaacnnntatctntanctaaanattgannagatnaangggttatngataatnggatantgtatnnttnangggtatnncnaacnanttatnttnntgggnggtngtanantnnanattaancttaatntantnngataatnttnttncatncnaagagggtgtanantttaatctttggggttttattngtaantataacnngaagcntancataagtangntanntnntnnnntcaaagantacccattttannaatnncnnntgggggganatatatattagtccccncgnggaanggncccccctttgtttgatggnngtnatnttacttatcnntatgtntagntatgntncnnnnatatntantatatctagntanntaannnatacatatctaccntatagtcanaaatngngtacattttttttnatnntnnnntanttnactaantatactactantaaanttnntatacnntnntaatntanacannnacngnacnntanttaanaatattcntcatncattngataataatntttnaancncnatanttnttatatantgantattgaaacatanatntntataactatnctagncnttatatncnaaaanannngtcnnattatncattctattngactantttatacnnanananttttatnacatttttcannatctntntantananttnaatctaaattnttncnataanntnatnttangatnntaacgtnttantatntaattatnaatatntantantntgtaatantaatgatttaanatntttnaagatacatngaactatcgantattaattatgtanttatctanttaatacnaaagttatatanggaatnatntctntcaatatnaatggtanaatatatacttantacgtaattaaatanataatataaatgnacatatatnaangtacnctatncactctnantatagtnttanatanaatactanttnatcgatatgtnatcgttannttatntactattatatattctntganngtattnttaggtntntatcttatnacagnnnatgtaaacntatctctaatantntntnagtannntatcntnntatntacttatctaatctatattaatcnttgttattntnccttnctgtactatgtgatatntatnatanantacttganaannatatntatgaaaattattatatnnatgttattatannntgatatantacatatnttatatannaactntattntnctantctntgttacanannnntataganncanagtntanntaagntatcganatnntagatannttatgnnatngatcnctatcnaanatanccgtnnntgattntacnatatntaatttnatnnatangtatncaancntattnacnatatnatnntntatcnattann

SEQ ID NO: 2570 - DNA, 761 bp, Homo sapiens
  misc_feature (1)...(761): n = A,T,C or G
acncatcatccgnntgcncttntanncccgntanntctttantgtctgcacntgnaancatncnttnggagctccncnatactangganacgccnctgacgctacnaacancnagatgaaatatgtatntatgnangccgatagnggcccnncatggtcaaaanaccgcncntaacgcccnngantnnatatctggcttnntcccatnngtgncnncgtgcaataactnagctgncnnctgtcnantccnntnntnnantnngcnagntgagtnntagtntttggcatttacagtnttttantatttacagttgatgatgaaanattcgtgaggtgctgccaaatatacatcaaaaggtggagcttgtntggccaactngccacctgatttaatcaacaactactagtgctgagatgcanaaagggggaaaatggaggaattatggaccaaagtctgtctttatagatgacantcacaggacaagggttaggctttgacttgcagactnctntctttgctctggncacccctgttnaccacaagccctnaattggggcnnttcanaanttatntcttggtnggcccgggcnccggttngcccacattcttgntattnccctnccccttttnggnacngcttttaancnntgnttaaaancaaacgntaangtccagggnaanatttttattanccnaanccngggccnnatntgtacgcttgaaaanaatcnctttntttataccaaattcatcnccacct

SEQ ID NO: 2571 - DNA, 704 bp, Homo sapiens
  misc_feature (1)...(704): n = A,T,C or G
taccacgatcgantccgtgctgtcggagtgacctgttctcctgagtgctctantgtctccagttgtcggggggaaagatgatggaggggaacagaaactggacttgatgtttgcggtttgagaggcaagaaaataaaataactttctacctctaaattgaggcttaggagtaaaaagcattttgtcctaaatttatcatttaaaatagcatcagtaacttttgagctcatgtcaatcaagcattggcagtcagagattttatagggaagactaagtaaatccagtttccaagaacctaaactgattgaggctccaagagtcagaccaacaaaagttttattctgtgttgtttactggtaagaatattattatcttgatactacctctcaagggtattgttacaaaatgccacttatggttaaagagatagatacaaagagttctatttgacagaagcttgaaactctggcatctatctgcccaacgatgggggctttcgttctgtaatttaatcctttgtagatcattatttgtgtgtaattttatacgtgttcatatttttctcattttgcattgngtaaagtgtacaaaatctcaaagtatnaaatactgcttatattgcttgtaattacagngtgtaaatattttctaattgggtcattgatgggggggacaagtgggttttcangttttttttaatgccc

SEQ ID NO: 2572 - DNA, 1078 bp, Homo sapiens
  misc_feature (1)...(1078): n = A,T,C or G
gaatatngatcttgtgtantcggagaagaggtgngctccccttngccccctcagcgagcccagcgtggggaccactcttcccgggagcaaggccacgcccntgggggcacttctcaggccagacagattgatttnccngcatgcggatccctggtncncnaaaatagttttgtttgaatgcnattctnttttngngnnggtacgtnttttnntttnttccanttaacattcttntnntatnnananaaaaatntattaaaaggtngntatcccattattaaaaaaagnagaacntnttggtannccttgcangaagaaagccctggtnaannattcccattgcnnancncctaaaaatnngnacttttttcgaaaacanatnccnnttatggactnnttttgttaattttttttanaaaaattatggtanttaatttattattngtaactnatnctgntatnnattaatatnnctatgatatantncatgtngcctacntntaatanttnttantatttgtnnnacnattatttttcctnttcnactnnnaantctttctaanatttgatcgtnnatnaattnntatttttattattatnnatgatttaagttcttttattttttttattnaatattatatattnttaatatcttatcttntctnttnaganntatattnatntgttaattatttatagtantatatacttactctaatcactnnnactnnttnnttatnttntacatnnttnctnnttataactatanttaatatattacattaaatgtattanngaaatataattntcnntatcttattttannanacgatantatnntattntacgtatgaatatantnagaaatnttatttatgctttanataataatctttngtantttatttaatnatanttattttanaatttctaatgatnctntatacatngtcnatcttaacatatnttagtntatnaaagatttgtagatntaanntaagnctttcntngtnatngnatctaatntatntctntatnaaantatantaagttangtntatctctatgctntnnancn

SEQ ID NO: 2573 - DNA, 1060 bp, Homo sapiens
  misc_feature (1)...(1060): n = A,T,C or G
ccnngtcntnnannntntnnntanaannattnnntnannnctntnttcnaanataatnaantntatnattggggngnancatcntaantnntntatagnacntcatnnccacnnannnngagngttatataatagntatnnnntntntnatnctgntnnnnnnnnnnnnnnnnnnnnangataaacantnntcnantccgggggctgtnattntgcactccagcccncngctaataagtagggaaactccgtctcaaaaaaaaaaagtanccatantcntnngggaagaccttacngnagagacttgtgagngganacctgaaggaaatgaaaagggaaggagtctgtnctgatntctaggaggaggaatnttccaggcngacggaanagaggcacaatgtctttgaggaaggggcatgttgggcatgtncacaggacnnnnaggaggccaaantgggtggagcaaaagagcccagggggagaggnattnaaaggaanaacaggccaaatggccataaaatnttgttngccttgatggggacattggccntgaccctgatcaaaatagggggtgacaggcnacagggaaactagggaggaggcttgngngctcgncattcatttgagganacccntatcatgtggaaactactgtgnaatannnttttggggtanntcccttttaaaaaaacnnngtcatttttccggtttgngcnccttgtgggcttnacacccttntaaatncccnaactaatttttngggaangcccaaagggttggggncaaaaatcaancnntggaaggtncanngaattttnttaaaaaanctnanctctttgaanccaaannatngngngtaaaaaaaacctttcnngnnncttttcaattntatagaanaattaccctaaaaaatttttctcctttngtaaaannggtgngtaggnacnncaaaataaaccccngtgagaaaattnccccacannnttttaccttttgngggggaaaaaaaatgaaaanggccccgngnnnaaaaanaattncgnctcttnagaaaaccccc

SEQ ID NO: 2574 - DNA, 737 bp, Homo sapiens
  misc_feature (1)...(737): n = A,T,C or G
aaccacgatcgantccgtgctgtcnggnnatnaataatttatggacactgctggacctcagtctcctcatctgaaagatgagtggttggagaagtttaatggttttcaaatgctttttttttcagtcttcaaataagtgtttacgtagaagcaccatatctgaacaggtgacagtggaccagtctgaatgaaatgagggttggcaggcctgagctccaaaaccttctgattgcccaagccctccttgtcttgcttggattatctccacacaaatggagaaactggacaaggtggtcatggaggtccctgaaagctcaaagactttctcattccaggattccccatgttcatatgccagcatggcatgggggtgctctgtagtcaagcagggtcctttggggggcttanggatggagccaggaaatggctctgggactcagcgggtgtccagantctcatcagcanggtttctttactttcactgagtggctggtgcctgcacacttgagttttgccagcttacttctcacaaaantgagctttnctggaagccccccaactgnaaaccccttttccnttcctggaacctnggtnccgacttggnggncctgaaaccaccccaaggcccttttccccantgctgntggaatgggncaaactttttttttgcacccctccnnggtttgncccaaatnnaacncttgataaaaaattnctngaagcccaaaatgccctcg

SEQ ID NO: 2575 - DNA, 706 bp, Homo sapiens
  misc_feature (1)...(706): n = A,T,C or G
taacnttnancnantccgtgctgtcnagaggagaacaaactggttgctgaagccatggtttccctgggaaggtggacccacctgtgcggcacctggaattcagaggaagggctcacatccttgtgggtaaatggtgaactggcggctaccactgttgagatggccacaggtcacattgttcctgagggaggaatcctgcagattggccaagaaaagaatggctgctgtgtgggtggtggctttgatgaaacattagccttctctgggagactcacaggcttcaatatctgggatagtgttcttagcaatgaagagataagagagaccggaggagcagagtcttgtcacatccgggggaatattgttgggtggggagtcacagagatccagccacatggaggagctcagtatgtttcataaatgttgtgaaactccacttgaagccaaagaaagaaactcacacttaaaacacatgccagttgggaaggtctgaaaactcagtgcataataggaacacttgagactaatgaaaganaagagttgagaccaatctttatttgtctggcccaaatactgaataaacagttgaaggaaanacattggaaaaagcttttgaggataatgttctaaactttatgccatggngctttcaagttaatgcttgngtcttttggcagaataaactttcaattattaaaaaggactn

SEQ ID NO: 2576 - DNA, 712 bp, Homo sapiens
  misc_feature (1)...(712): n = A,T,C or G
tacctcgntcgaattccgtgctgtcggacggaaaccatgtttgtggctcgcagcatcgcggcggaccacaaggatctcatccacgatgtctctttcgacttccacgggcggcggatggcaacctgctccagcgatcagagcgttaaggtctgggataaaagtgaaagtggtgattggcattgtactgctagctggaagacacatagtggatctgtatggcgtgtgacatgggcccatcctgaatttgggcaggttttggcttcctgttcttttgaccgaacagctgctgtatgggaagaaatagtaggagaatcaaatgataaactgcgaggacagagccactgggttaaaaggacaactctggtggatagcagaacatctgttactgatgtgaagtttgctcccaagcacatgggtcttatgttagcaacctgttccgcagatggtatagtaagaatctatgaggcaccagatgttatgaatctcagccagtggtctttgcagcatgagatctcatgtaagctaagctgtagttgtatttctttggaacccttcaagctctcgtgctcattcccccatgatcgccgtaggaagtgatgacagtagccccaacgcaatggccaanggtcaaaattttgaatattaatgaaaacccccaggaaatatgccaaaagcttgaaactcttatgacagtcactggatcctgttcatg

SEQ ID NO: 2577 - DNA, 993 bp, Homo sapiens
  misc_feature (1)...(993): n = A,T,C or G
nncncttatcgantccgtnctgtcgggacactttgtgantcccattngangangcnctggtgtgtgngngggatgaggtgctggtgtgcggatggatgaggtgctggtgtgtngntggatgagatgctgnngtgtggatggatgagatgctggtgngtggatggatgangtgctntgtggatggatgangtgctggtgtgtggatggatgacgtgctggtgtgtggatgaggtgctggtgtgaggatggaccacnttnnggttttcncgtttnggcactnnggntgantncncttttctgctcttgcanttgnnncctgcgaaanttcnccggacanntgcatacatctttgtatgcaccggcatcactttgggnanatgattncgtncctcgtgtnnggttngggaananannatatataaatgtnctcttntcttacatnttatcnttnncaccccnnccntntgnngctcccaagncnattnacctccacctgnttctatccntccgcncgantgtcgtnatncagagggngatcccactcaacntttttnggatctccctttcnaagtctttnnatnantccttnntcntttncttttgtaagtctntnaatgntagctctccanaaatattctntcccttgcggnnaaaaaanananngacccttcacnctttcgnggctntgagagcacacntcaactcctctcccccatctttnctnttntttnaacnnctatattatcnctattatcactctntggtaagacgtnaccccnctnntaaccantatnnctttncgtnnatannaaccnnctctttatcattaggggactctttttntaganataatntcttacatangcacgcntnnaaaatantacactcgcggtcnnncactctantanntatncaactnnccccnccccccccctntcttcntcnnncccntcttnnttgcnntcttcngtntttntacttccnatntanncc

SEQ ID NO: 2578 - DNA, 675 bp, Homo sapiens
  misc_feature (1)...(675): n = A,T,C or G
ttttnnncccntgaantaaaaaaactagcacantcnannttgctnnntgaagataagaaccataacatgtatgttgcaggatgtacagaagttgaagtgaaatctactgaggaggcttttgaagttttctggagaggccagaaaaagagacgtattgctaatacccatttgaatcgtgagtccagccgttcccatagcgtgttcaacattaaattagttcaggctcccttggatgcagatggagacaatgtcttacaggaaaaagaacaaatcactataagtcagttgtccttggtagatcttgctggaagtgaaagaactaaccggaccagagcagaagggaacagattacgtgaagctggtaatattaatcagtcactaatgacgctaagaacatgtatggatgtcctaagagagaaccaaatgtatggaactaacaagatggttccatatcgagattcaaagttaacccatctgttcaagaactactttnatggggaaggaaaagtgcggatgatcgtgtgtgtgaaccccaangctgaagattatgaanaaaacttgccagtcatgagatttgcngaagtgactcaagaagttgaagtaccaagactgtaacaagcatatgtggttacccctgggangagatcaaaaccacctcgaggncagtgggaatga

SEQ ID NO: 2579 - DNA, 667 bp, Homo sapiens
  misc_feature (1)...(667): n = A,T,C or G
tnncntgctgtcgattacatnntncngctnaggcgctggcagctgaagagcgtgttaggactctgcaggaagaggagaggtggtgtgagagcctggagaagacactctcccaaactaaacggcngctttcagaaagggagcagcaattggtggagaaatcaggtgagctgttggccctccagaaagaggcagattctatgagggcagacttcagccttctgcggaaccagttcttgacagaaagaaagaaagctgagaagcaggtggccagcctgaaggaagcacttaagatccagcggagccagctggagaaaaaccttcttgagcaaaaacaggagaacagctgcatacaaaaggaaatggcaacaattgaactggtagcccaggacaaccatgagcgggccaggcgcctgatgaaggagctcaaccagatgcagtatgagtacacggagctcaagaaacagatggcaaaccaaaaagatttggagagaagacaaatggaaatcagtgatgcaatgaggacacttaaatctgaggtgaaggatgaaatcagaaccacttgaagaatttaatcagtttcttccanactccacagatctagaactntttggaagaacgaaacctagagggaatggaacttgaaanacctcattnctgatnagacttg

SEQ ID NO: 2580 - DNA, 704 bp, Homo sapiens
  misc_feature (1)...(704): n = A,T,C or G
taacctcgntcgattccgtgctgtcgttanaccaagatagccaagtggaacctgcaatcaagaatgaataagaatgaggctatagtgatgaaagaagcaagtaggcaaaaaactgtagctttaaaaaaggcatctaaagtttacaaacaaaggcttgaccattttacaggagctattgaaaagcttacttcccaaattagagatcaggaagccaagttgtctgaaacaatttcagcttccaatgcctggaaaagtcattatgagaaaattgtaatagaaaaaaccgaattggaagtacagattgaaacaatgaaaaagcaaatcattaatcttttggaagatctgaagaaaatggaagaccatggaaaaaattcatgtgaagaaattcttagaaaagttcactcaattgaatatgaaaatgaaactctgaatcttgagaatacaaaattaaagactacacttgctgctttgaaggatgaagttgtatctgttgaaaatgaactctcagaattgcaagaagtagaaaaaaaaacagaaaacccttattgaaatgtataaaactcangtacaaaagttgcaagaagcactgaaatagtaaaaaagcagatgtgaaaatttgcttcctaaaaattacccattaccaaaacccaaaataaaatgttagaagatgaaaggcccatggagtctcactgaagggttagagc

SEQ ID NO: 2581 - DNA, 1252 bp, Homo sapiens
  misc_feature (1)...(1252): n = A,T,C or G
nnaacnnngnncgaattccgtgngctgtcagccgccgcctctccccccnacactgnnccctgcggtgntngaaaacaccacctgatggccatgganggctacnnnnagcaaccggggtngttctgtcaatatcaantnngattcattaatntnctgacattactggacaagatggnacntgccatncanaaagctagtngttntntcntattntttcctaatacnacngagnnanactancntatnnntnccnttntgncnngatttangnnnncntnnnaatnntaanaatcntcnanatnatcttnanncntnatnnnttctanannantnaacattanattacaanncttacaaantccanantnnaatantctctctanatagaatatggcaataatntatnctatcgtnngtagttctcatanttatcnantgctnatatnnagtntaactnccacatactanttcanactatatnnctatcanctcactctctnttacggntcctacntaaaactcnatacntctctatnttntantatctatcnctctntntatatntctagccactnnnncttancctcataaagtntnaatcacannntntntntntgatntcttcatatagagctaanctancatatantatttcataatatcgagtatnatncnganatctcgntcttantactnngnatatacacnacatatatccntnantccaatnattannnancnctatatancnatctctantcncactattctcncgctgatnacantagaaatacnnatatancacctctntccnananattntcnacncatctnacatcnnttgtactccactactnaaaacnngnacatgtcatctatantantctntctatatacagtnnatnctcnaatanactcgnctttcanaaagntnanacgatanatgannntncnnacncataatcttnacctactactcanatggannttgctctnataataccagncgatggncncatttcacttttnntacactgatntctntatactnaaanannatagtatgttcatgntactcacncatntncaattccanatantgtntgtnntatcgtncacntctgagatcgatctnatanatancnantcgcnttatncanactcnaatcctagagnccatcactccnacnntaantatatctntacatntgatggcgntntcncntntctatctntcanaaacnagatngcc

SEQ ID NO: 2582 - DNA, 1306 bp, Homo sapiens
  misc_feature (1)...(1306): n = A,T,C or G
cctcttcccgnnngttntnntcntntgaatgtnntntatgttntgtgtnntantgntntntntgttctncatngtgtttctgtnntttgtaantacnntnnatatnanttgtggagnnanataacnatnnnatatnanttctngatgatnnntnncnnnattaancntgatcgantccggggctgttnttctccgcanagggcccctgccttggntcttctataagacaaggngtncataatnngggnatgaccttgagacaanaactgtnggngactttttctgccatagaccagatngctatggntgaatataatgttttgntncganntctannatgcatanntgnttantctnttttcggnnngngnnnnatnnngtcgttttntttnatttctcatnaatnctntnctctattnncttatngngtgtnncgtgnttcntgnntanttntgtngntcttanaagttttnanaaattttngntntgaanttacnaaannttgnttntgannttnttnnnattgtntanancnntntttccatntnatttttatccgatatnttntnntcntttcntntgttctcttattngatttatanttantnnactgtntctacattntatnagattctagtctgtatgattngnantntcnntanattatgttntcnggtgtnntgtaanaannncangttatgnnatgataatttagnnanntctggtcnnnacatctttncnctaactatntntntgtctgtgattnnancnntcatantttngantttctttcttttnngaattaatatnnntngantggtgaatgnncatatcaccntgcgcntagctacttatgtacnttttcctctacagcacnctttcatacatttatatagatcagnannntatntngattngcattctatagtntgngtatttcctctaactctctntgtgncaacattgcgtctntnnntaangatntacataagcnatancatnnnattnttnttnntcgttnttgttnntcntcnntggtatntatatnnntcttatagtnanttntgtnatnantaanntcttntnatantatcatagcttttagggtntaatantacgnggntatntcnnttaccttagtgtantatatnatatntnntaatacatttggngnctgngnacntnnccttttnnttatctatatctatgangngtntccatatnanccntattgngataggggtgntctggtggtnaccactnnngantgtctnttatatnttntnantntntnacnattctctnt

SEQ ID NO: 2583 - DNA, 728 bp, Homo sapiens
  misc_feature (1)...(728): n = A,T,C or G
tacctcgntcgantccgttgctgtcggaaacctcaacagacactgccgtaacgaatgaatgggagaagaggctttccacctcccccgtgcgactggccgccaggcaggaggatgcccccatgatcgaaccacttgtccctgaagagaaaatggaaaccaagacggagtccagtggaatagagacggaacccaccgtgcaccacctgccgcttagcactgagaaggtggtgcaggagaccgtgttggtggaggagcggcgtgtggtgcacgcgagtggggatgcttcttactcggcgggagacagcggggatgctgcagcacagcccgcattcacaggcattaaagggaaagagggctctgccttgacggagggggctaaagaggaaggaggggaggaggtcgctaaagctgtcctggaacaggaagagacagccgctgcttcccgtgagcgacaagaggagcagagtgcagccatccacatttcagaaactttggaacaaaaacctcattttgagtcctcaacggtgaagacggaaaccatcagttttggcagtgtttcaccgggaggagtaaagctagaaatttccacgaaggaaatgccagtagttcacacccgaaacccaaaaccatcacatatgaatcatcacanggtcgatcccaggccccaagatcttggaagcccaggcgtgccttgatgagtgccacagaccgatcaccttcttgaaact

SEQ ID NO: 2584 - DNA, 710 bp, Homo sapiens
  misc_feature (1)...(710): n = A,T,C or G
agccttntnnatcccgtngctgtcgctctgtttctctggctaatgtatttttatcacacccaagaaatttaacgtttataagatgtaatcatttaatataccaaccatgtgtatactgcttcagttgctcctcagattcctgaatctaatcagatataacactttgcattttgtttaccggtctctctagtcttctgtaattttcccagttttttcccataatactgatttttttttcagcattaaagctagctctcttgtagagtagtccacagtctgaatttatctgattgtttcatgattagattcagattaaatatttttggagaaatacagcataggtgattttttttccctgttgcattatatcaggaggcatgaaaggttagcctgcatgattattggtgatgttaaatttgatcacttgattaaggtagagtctgctggtagaaaacatacctttgaaattaaaagttatcagtaaccaaagattatcttgttcaatgaccatctctcatctaataggttttgtcatttatttatgatccttgccagaatcagtgattaccttagtggttgcaaaatattgattttctacttcaagagatgtgttaaaatttctttttaaaaattgttaccctaagatggcccttggctatagtaatcattgctctttttatttanaatggattaggaagtntgtgagaagn

SEQ ID NO: 2585 - DNA, 1453 bp, Homo sapiens
  misc_feature (1)...(1453): n = A,T,C or G
ctcgctccntatnnanttntaannctgtgtnnctatgtatgntnganatatcntctanttnggattangtatctattgantttttttntacnggggtcntattnacntattnctntttacancatggttnntnnntnnttnnttaccnngatcnannccggggctgtnnttgttcaccgagatgcgccttctgggacacttccccttggtgccatcatccctgctcctnactttncttcctctccccttcccatgngatgtgntgcttgatttgttttacccctcncanttttttnatantantctntncaatanncantntatanctttantntcnactttntnanactatnattttctntcnntaactcacttntattnttncntttctatgatgaanntttnttntantncgatttgacnagntnttatgataatctnatactactctcntaatatatnanntntngttttatnttgttacctngtatcnncttacttatnttnactntacntatctntntctantntnntatttaattcctanactattctaatncgcatcnttctattgtanttatttaatgnncannttngtcctncntctctatacacanctantacattantnntagntaactatcnnnnntattntctgtccgtntttcttcnttangntgtnnntcanatatgatnnctgtttgncnactctgactatcngnacattttctnggtattcncacggacnctcnctcntcatnttcatnacanncatntatnctatactntancttacnaatnantacnnttntcanatatncnatcntncntatagtntnttatnttatctataantaatntaagtacntnattctttttactgtcncnaaacaatgccatgntatctacntcatcnattatnttntctnntacnantgtactatnntctnctctatctaaatnatntcttcnaanncgtatagntatcttaatntantnnanataatacctatngntantacgtatcctatcaanatnatcgnnacncnttgatctgttatnttantntantaacatancttcntatctangttaagnatgtatatatnancnnacatnanntattctatgcntaantatcttatnntattanntcanccnctctcnctntcntatactttcntaaacgcactatatnntgtanatntaactaanctnctctctatctatgttcacctnttatanaaatctatcatacnattananntcgatngtatctatntctnttctcatacttngtntctgnaaccctnttaccagcatcacttatttctngatnanctatntaatttccgntacgctanncntntatgtaatntnnttnnnaactnatntctcancccnctcntatctaaanngttacncataatntacctgtctcncgnncatnnnc

SEQ ID NO: 2586 - DNA, 711 bp, Homo sapiens
  misc_feature (1)...(711): n = A,T,C or G
tnaccacgatcgantccgtgctgtcgaaattttccagttcttttttcagcttctttatttcctcctaatggaaacattatctttaaaagttgcatataggaaatatacatattttacgtttgaacaaggagatttaattgtaaatatgaaagccaaagtattcctgaatggtcaaatacagcaataaaggcagaagaattaagatttttctttgttccattgtacagtgtaaataactaagttgttaactgtcaagtccagttatgtattctgtaagttgtgttctagtctttgactaaaatttatcatctcttataatgggacttaatctttctctaaaagcatataagagcttgtcaatagagcaatcaatcaaaaagattttgtgattcataacattgaagttagtctggttaagagttttggtttagacttcatttatattttccttactaatatctaatatttaatgaataatgatcaattttttataaagttattaatatgatcagggaaacctttgggacttctgacaggcatctggtgaagagacaattcaagccttagtgactatttagaatagccagtgatcactagctaattctcatatccatgcctttttgtcctgtttacagtcttaaaagangtaaaacagcaaatatttttttaagggactataccttaaggattcctgaaaaagaatttcaaaaa

SEQ ID NO: 2587 - DNA, 704 bp, Homo sapiens
  misc_feature (1)...(704): n = A,T,C or G
taccncgntcgantccgtgctgtcngccttttaatagttccagtgaggtgagagctggatgaggtgggtacaacagaatcatcaaaaatctggccgttgatgggacctcagagtcacttgaggaagcaacatttgagcagcatctaggagccttctgggaaaagatggagaaaactaaagacgttaggtttattgcaaaccaatcaatcatactcactgatcacctactagaggaaacctgtgataacacttgtggggagatttatagaaagaagacgtatttgcacatcaggattttacatcatgatgtgtgcctgtgtgtgtctgaaaaatactagcataacaagctggtgagtacactatgaaaaaaaacaacaacacctacttcatttggcagagcaccagaaatgagggggtaatgaggtcctgtctttgtggcatggtaaaaaaaaaaaaaaattgcccttttaattcagtttnttnttctgaaatgaaaaaagtaanatttaccccctgaatacttgacaggatgtttgcaaggcttggttaatttntgtaaatgttttgagctcctntgangngtgtgttctntaaataggaggtttaatagcaccgtcanactgaacaaactganttgagctgcantnnttttccgggaaanaaacccaacccccntaaagcntgacccccttctgggnttgcnc

SEQ ID NO: 2588 - DNA, 726 bp, Homo sapiens
  misc_feature (1)...(726): n = A,T,C or G
tacctngnncgattccgtgctgtcnnactgantaggtngcgcngtncanactnacacagcacctcgnttntacacaggaganngaaatggccgtacttcnagaactgcagtgcttgtgaggggatattncngccnnnngantttnngatgtncatggncattgtntnaaggtnnngngnntnncctnnatgtggactttgaatggtncatcaaaagattggtttttgcagagattttaaagggggagaattctacaaanaantgntacctnnttannncnncntnaangatganaatcctggtngaagntngttnaaaaanngctaaattacntagacntangcattancnnntnngngnnncaatntngccaccncctntggnatcatctagagtgaatgttaccaanatngcattctaagntctatttaactgactcgcactgnatgacgaatttaaaaaccttctttgnatnggnttancaaaactgtgcntcaccattgcacanttantgtcctatctatncatncgaaactttggggggcctgttagccnacacttnaggaccnggccatctcattgggactcattgatggcttntntncntanaaacantttntgttttnaacngggtatnacctcttntttangggattttttttttngaccccaannactantttgagnatnttnnttttgcgcaaaaaaaaatgggtttctttannt

SEQ ID NO: 2589 - DNA, 1444 bp, Homo sapiens
  misc_feature (1)...(1444): n = A,T,C or G
cccccccccnnatattanntgtgtncnactnnanggagtnntttnntttnctctnnnagttntangttaatcttnatnanncntncntccagatacatagangcntgggnttnttccccatngcccctanngggntttnntaanaanntaatcccncnntattgagcatcntttncgccnatnagaacncngggnntattttngaactaggaanatcgttcacnncntngcnggtgagttcatgattaatanattacanangtggatnaantnnaaanacgtcagtananctatnttntannctnaganagngtgantgnantnncnnacgaacnganntnntatngtactnctgangtaggntactaaattacctnnanataatnacatctaagtatngtgggtctctaatgttatgaangntacgctnttaanngttngttnttgcgcgntanntancnaaacatanntaactantggtgacaacatntngntcagcnacnntctcttaannatgggaangnacanatgncngnatcgtacattanggctcgngtatcatgagnnctgntnataanagataaggatanntntccntaatggaattctaantgtatgggcanataaaangtanntgaaancgnnntgcnaattgctacgaanantgnatgcaatagnngaagcgtatgtaagggtncgctcttntacgnanatatatagtnttgntnatancgatcntataannttatcttatgtatatctnnnacattttaagntacacgtgaangannttgccanngcannattacatnacattgntntnagtaagtgatnggnacangcttagggaaatcantgagcncagggnatntnaatatnatcggnntaccntaggtnatnngaanatgnnnatgtaaaagngttcnnaatatatactntnaacgatctgnnangtgtanggagtnntctaacacanggttaatntacggtnagtgagngaaannnattangtatncatatanaatngtgaagcaaagaatntcgaacncttanntcacnttcagctatntaagctngagtacacnagcattnnntcntnanntaancaatngctacacgtctanactngcnatatggtagagnatcacangaacgtactcntttatnctcaggaatnnatgaacggtgagacttntnaacgtntacangnnaggaaatatnatncnatgtctagntagnacnaatatnttctaacngacnaatnangtantnngttgntnaannacntcntgncntatnttnnattnntccacatantatatncngaagatcaatattntatcatnactgtatgntagacnanttgttantantaanaacgnagcnctanacnntnncgcaggantatntannnacntngtacgnctnctatacnnntannncg

SEQ ID NO: 2590 - DNA, 739 bp, Homo sapiens
  misc_feature (1)...(739): n = A,T,C or G
naaccacgatcgaattccgttgctgtcgttgtccttttctaatagttcgtgttttagaaattcagaacaaacaatttctgaatgctcctcagaacgccaactcaggcagagaatctcaccgaaatagagaagaagctcatgctcctggaagaaacagcccgaggagagccgctgggccacatctggccactgtccgcagcgctgtcagattgctggggccacatctggccactgtccacagtgctgtcagatccaaggagagccgctgggccacatctggccactgtccacagcgctgtcagatgccgaccaaaccctgctttggtgttgaggtggttcgtctggtagcctcctttcttaagggtatttaatctgctgcaaattgttttcatgtatgcaatagatgttactgtaactgttttataaggtgcattgtcttcaccttggcaggctctgtgccagtctgtgtctagtctgatgccattcctgcacacatacatccttgccccancattttgganggctggagttaaggaataatcctggtggggacttaatattaactatttgggantgggaacttaatattggatcctcatggtccaactgggccccacctttcccaaaccccaaaaaaanggntgaanaatttntcttttttaacaaaaaacattttaacgattaagggccaatacttnttaaaaatnaggttaattaaagtttnattnccccacccaat

SEQ ID NO: 2591 - DNA, 704 bp, Homo sapiens
  misc_feature (1)...(704): n = A,T,C or G
naaccncgntcgantccgtgctgtcggcagagcgaaaggtggncgagtcctgaaggagggcctgatgtcttcatcattctcaaattcttaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattgggggctaccgagtactctgcgggagaaaaaagtcgtctatganaatgcttatnggcaatttattggtcctcacaggattaaggcaccaattattaaggccaagaaaaaaaaaaaaaaaactcctggnn

SEQ ID NO: 2592 - DNA, 1481 bp, Homo sapiens
  misc_feature (1)...(1481): n = A,T,C or G
cnncccncnnancanngnngntgaaagntgtgntgatggatatnnaantnantatatggnntatattaatgttttatnngtacccctntnaggtnttntanntagtnttntctttcctatngtnnnnnnnnnnnnnatgantaccnngntngaatccggggctgtantcggcannnngtcccccggctngnganaattattatatnnatattacgnatannnatacattanaattgttttcntcttaaaatttggggggntttttttnatntcgagnatnanttntnaatnngcgatttctctatacnattgtcnatntantanccttatatnangatctnctatgcattanancatgtattntnnatgtgttntgtannattcttntgcnttgntntatnaaatcnctgtatttataagnatngtagnatnnttttatnaatacnnangcngtanttatnntnctattnagtntntaattagttcnaagnaanttattacanatnaatntttntatananggtagntagctgtgatgcnatcgaactnttatntnatatgtatattngcaaaggactanataatngtatgttatntnnncntncnangtacgtgncnnaaggtatcgatgtnatnanctgcnncgtananatnnngannntattnangtnatngatntnatcgctacgttntngcnaaatatcgttcctattttnctnancnnanntatgntagantatgagnantataccntacgtaagganntatnatatnttgtgntatcgtanntnaaacgtantatancgtntgngatgtgcatnantattanannttanngaatganntangaataggngnnntgagtgnagtaatntncatatttnngtatanattgcnctangnacgtgtctgaagtntgtntatngctctcattatttatttcgancgctantatttgttatgtantgattacctannttangtaatatntattnagnnctcttgcagtttatntgtntagntatggnatcnnactnatataanatantagttgnntatganatctaattgnangtacaannaantcaangtnatattnaatnacgatgagnancgtnanattagnntatnntactgtaatttaggctatatagtattntgnntancnaaanannacncatcttntncattcncncgatnnntctatctttngcangntcaagcaatnnatgntnanctananaggtaggntcatanntagtntatnntattaattagcnatnttcgtatcngcacnanatagntantatantttnannnattntaggntctgtattatatnantcncttngagttntnncnnaagtatagnnctacatcatgtncatcntantnntggananatcncncgttnttgatgactgnagtgantaanttacnagatngaatatatnngngctatctaaaactacnacgttang

SEQ ID NO: 2593 - DNA, 756 bp, Homo sapiens
  misc_feature (1)...(756): n = A,T,C or G
ttncctttttcnaattccgttgctgtcggnacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggccaccccccaaggtgaagaactgaagttcagcgctgtcaggattgcgagagatgtgtgttgatactgttgcacgtgtgtttttctattaaaagactcatccgtcaaaaaaaaaaaaaaaaaaaaaaaaaaaaaaaaaaaaaaaaaaaaaaaaaaaaaaaaaaaanncnnnnnnnngggggnttttttttttttttnccnnaaanaaaaaaannnttnnnggggnnnnncccccccccctnttnnnttnnnnnnnnnnnnnnnnnnnnnnnnnnnnnnnnnnnnnnnnnnnttnnnnnnnnnttntnnnnnnnnttnnnnnnnnnnnntnnnnnnnnnnnnnnnnnnnnnnnnnntnnnnntntnntnntnnnnntnnnnnnnntttnnnntnnnnnnnntttnnntttnntnnnnnnnnnnnnntntnntttnnnnnnnnnnnnnnnnnnnnnnnnnnnnnnnnnnnnnntnnnnnntnnnntnnnnnnnnnnnnnnntnnnnntnnnnntnnnttnnnnntnntnntntnnnntnnnnnnnnnnnnnnnnnnnttc

SEQ ID NO: 2594 - DNA, 684 bp, Homo sapiens
  misc_feature (1)...(684): n = A,T,C or G
cccatactcncatntccagctctatgctcagagaattaccagaaaataaaattacatgaagcttgaatatagggagatggaaagatattagacaaatattaaagaaaatctgggccaggtgtggtggctcacacctgcaatcccagcactttgggaggcccaaggtgggaagattacttgaggcaaggggtttgagaccagcccgggcaacatagtgaaactctgtctctttaaaaaagaaagaaaagaaaagaaagaaagaaaagaaaatctcagtgagtgatggtcagaatagaattcaacataacaagctcattattaaaatatttgatctcactgtgtacaattctgaagacactcattcatgtacttcattaaatatttctagtttgctaaaaatagaattacccttcaacccagcaatcccattactgggtatctaccaaaaggaaaaaaaaaatcattctatgaaaagatgcctgcacttgtatgttcatcacagaactatttcagtagcaaagacatggaatcaacccangtgcccatcaacagggggactggataaaanaaaggggtggtacaccggccccccttgggaatactattgccgccctttaaaaaaaccatggaaatcctgtncctttgcaataacntngattccactnggagggcatttttncttaa

SEQ ID NO: 2595 - DNA, 708 bp, Homo sapiens
  misc_feature (1)...(708): n = A,T,C or G
taacctcgntcgantccgtgctgtcgntttccactattgacactgcccggctgattcaagcttttggccatgaaagagtatgcttgtcacccagacgaattaaattatatagcagcatcaccaaccaacagaggagataccttgagaagcggagcaaacacagcaagaaagtgctgaatacaggtcatcccctagtgacttctgagcacaccagaaggagacacatccaggtagcaaaccatgtgatttcttctgactctatttcctcttctgccagtagtttcctgagctcaaactctactttttgcaacaagcagaatgtacacatgttaaacaagggcatacaagcaggtaacttggagattgtgaacggtgccaaaaaacacactcgagatgttgggataactttcccaactccaagttccagcgaggctaaattggaagagaacagtgatgtgacttcttggtcagaagaaaaacgtgaagagaaaatgctctttaccggttatcctgaggacagaaagttaaaaaagaacaagaagaattcccatgaaggagtttcctggtttgttcctgtggaaaatgtggagtctagatcaaagaaggaaaacgtgcctaacacttgtggcctgggcatctctgggttgaacccattaccaagaaccgaccctggagggagccactgngggagcaaacttgtcangggct

SEQ ID NO: 2596 - DNA, 694 bp, Homo sapiens
  misc_feature (1)...(694): n = A,T,C or G
gngctgtcacactgaagttttgttcnagacactttgggcttcgctgattgaaaacaccacaccaactgaaaaatcactgtgaaaaagaacctggtagtactgtcaatatcaagtaggattcattaattttctgacattactggacaagatggttcgtgccattcagaaagctctttttctttcttcttctttcctaatacagtgaggcatacaacgtagcctgccttatggttaagttgggtgtatgacttgtaaacttccctcttgctattaaagattatataatgggaagttcattggttttgaaaggcagaccaaacccacccatgggatttctattggctttttagatgtattgcatttctctgagtaaacccatgtggctgagaaatagtgagtagcttgttggctgactgtgggaaaacctatgaaggatcagttgatctcatttgggcaggagtcagaaatggctgagaatctaaaactatatatatgaggatggttttctcttgatgttgcaatctttattttaacatgtttttgtgtttagcttctggagttgcctaacagtataatttcaaatgaggtttaatttcagctgtttaattttaaactgtangggaacatgattaaaaaaaaattaaaggctttatcatttgccttaaaattttaatggtttggtataaaaaagant

SEQ ID NO: 2597 - DNA, 712 bp, Homo sapiens
  misc_feature (1)...(712): n = A,T,C or G
tgacctcgntcgantccgtgctgtcggcctaagcataaaaccaaaattataaaactcctagaagataacacaggagaaaacctggatgaccttgggttggcaatgactttttagatacaataccaaaggcatgctccttgaaagaaataattaattgagaagccagaaggcaaaatggtacagccattttggaagacagtttggccgtttctcacaaaactaaatatactcttaccataccatgcagcaattatactccttggtgtttacccaagacttgaaaacttgtgtctacacaaaaatctgcacgagtgtttaaagcagctttatttttatttataattgccaaagcttggaggcaagtaagatgtcctttggtaagtgaatgggtaaactatggttcatccagataatgagatactattcaatgttaaaaataaataagctatcaagccatggggagagatggaggaaactgacatgcatactattaagtgaaagaagcccatctgaaaacgctacgtactatatggttccaactgtatgacgtcctggaaaaggcaaaactttggaaacagtaaaaagatcaatggttagcaggatttgggcaggggaanggatgaataggcagatcacagatgatttttangagagtaaaaaatgcacngnattagaatggatggatcatattatccatttgtncaaacccnct

SEQ ID NO: 2598 - DNA, 860 bp, Homo sapiens
  misc_feature (1)...(860): n = A,T,C or G
cgncctcgntcgattccgttgctgtcngcgcctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgccatttttttttttgttcaaatgattttaattattggaatgcncaatttttttaatntncaaataaaaagtttaaaancttaaaaaaaaaaaaaaaaaaaaccncnngngnccnttttttccttaaanccnancttnaaaaaancctttnnnnatttngnccnnccccccnntaaanttcnnnncnntcttactntnnttncnatttttctttttantntnnnntctnccntcattttctnttnnnttttttnnanncntntntnctcnanttctntactntnnnattcactnctctacttcncnttctactntttnnnnnanntcttncntnnntntatctnctctnntcactntnntnnnnnttnnctcctncnnntcnntnnnctcncttncncncnccnncattcntnnnnnntnnntattntnnnnncnncnanctnntcnnccntncnatntnctnnnntnncntctnnnctcnttcnntatctnnnnnncttcttnnanntncntcnnntntcnntcnnnctnanctttnnnnnnnnttatnanntctcnntancactnntntnttncatnnnncttntnttnnnttncntnatntnctcnntanctnttnttancnctactctcantntntnttnccttnnnnnnnttncc

SEQ ID NO: 2599 - DNA, 939 bp, Homo sapiens
  misc_feature (1)...(939): n = A,T,C or G
cnacnacnnnnnannnannnnnangngnnanannganaannaggnantannnnngannnnnanaanannnnnnanggggagancangnanngannntaannccacnnnnnnnnnngaggcgaannnnnaaagtannnannnannannnagnannnnannnnnnnnnnnnnnnnnntaanacccttgngaaaaacccgggggctgtnaaaacnncgcngaggncccgctgnngcnggaanagtagaatcaagaaccgaggattttacatgggactgggaggacgagcaaaaggaggcttaccgaatccggagatcccgaggaggaggaagaggaagaggaggaataannggnaagaactgtcacaggtanggaaacatctcagnaaaagcagggattgagcttcatgaaatnctaagggcatatnaaggagcaangacttgaaaccnngtaaganaangggggtggaataanctctgatacntccatgngcantggagagnnaaaggngagagccacggaaagcacgagacagntcngngtaaggggncttttncagttgnggaancagggagcaaanggcatcnagagggnccngcaacacaaancaatatgcttannagagggatnaatnaanaacnnnggagctaggcatgngaggcntcgagcctggnaaactacaacactntgggaaggccaaggnaggcggagaataccaacccngaaacaaacggtagagaaaaccccatctcnactaaaaaancaaaaaatgagncgnggcgtnggnggcacaancccggnanncccanatncncanaaagctnnagggcangaagaaanncntcgaaaccagaacaagcagaangtaggaggncganatnaaaatagagccagatngngganccaacangngnnaaaaagaacaaaaacatcnaccnaaag

SEQ ID NO: 2600 - DNA, 711 bp, Homo sapiens
  misc_feature (1)...(711): n = A,T,C or G
gncacgatcgaatccgttgctgtcggggtgagagagatggtgttctggacacttccccttggtgccatcatccctgctcctcctttccttcctctccccttcccatgaatgtggggcttgatttgttttaccccttaagtgggctgaagatgtaaagcttaacctcttccaaactagatgctttgaggttccagctgtcactgagaacagcttggtagctggtgcagcgtaccagcgtgcagaggcagcattgttcagctggagcctcactgctggagcctcatctaccagagggctccttccatactgcctccatgcttcgctgtagaatcaggaggcgaccacagcagcagaacactgccaccctaggatccagagctattgcacaaaattcacacacaggtgtggctgtgacgtgtggccataagcatcttcttcctttatggcacagtttctgagtgtagcagagcttgatgggggtgagcccaacacccacacttctcctcactgccttcctcccttctcagcacctcgtaactgaggctggctgaaggaaaggaagcaccagagatgattcccgaggtgtttttaggtcaggaggcactggcatgaggcangctctgcagttgggtatgacctgccctgctttacctgggaccagaaattnctgggaanggggctctcaacgctgaaatggtgatgtnggggnaa

SEQ ID NO: 2601 - DNA, 710 bp, Homo sapiens
  misc_feature (1)...(710): n = A,T,C or G
nacacgntcgantccgtgctgtcgctgggctagaacctcantctagtgttcaaaggagctggcagaatgggttgtctcggcatggaggacccaaaagcagagctccctggtgctttgggggagagtgaagcccttcattccactcctcattgcagaccagctttcctggtattcatgcactgctttttgtaacgcctcaaatgaaggccacagctcagccaagtagaagagagctcctaataaatgaagtctggttgcctttgaatttataaaataatcaaagttgctatttcctgctaaggagacagatacagaacaggtgataggccacagtcattactgtcccctgcttgttccctgagcccctggccttctaccttttctaactgctgtcagaaccctggttggggacttccttttgcctggttctcctgggcttgaatggcaacctatattgacagatttcatgccacagttctttttcaaacaagatgattcacaatggaataattgggtttgggaagaagcctttttaaagcaaactatggaaaataattgatgagtagcgcagttttataaaacttttttttctattacccttttaaaaactatgttgctaactgcacatcacactgcattcatatnctggggactaataccccttgaccttgccatttgaattaangnggaaaaaaggtcataagtnacat

SEQ ID NO: 2602 - DNA, 715 bp, Homo sapiens
  misc_feature (1)...(715): n = A,T,C or G
naccncgatcgantccgntgctgtcggagagtggaggccagagaagaccaaagctgaggaatgcgacctcaggatttccttctttctggggatagttctctttaggaggaagaggagttagcccctcacttgcttatccctctcctatgctctggagttcctctccacccttgcccccaccccacattgccccctcctgctcggtcagtgcctggccagctcaggcagcttgcgtcacagtaaggtaaagccagaatgagttttaggtctgagtgagattggaaaagccattcctctgaccctccccacctgctcccgtctctccaggcatcctacctgcaagaggacactgtgaggcgcaaaaaatgtcccttccagagctggccagaagcctgtgagtgctgttgacacgcacccttgtgcacacacatcccctttctctttctgtctcctacacacacatgtacacacacacacacacacaccccgcacttcacacatgtgctgggggaagtccccagaagcatgcaggtactttccctggagtcagtggggggaaaagggctgccaagtctaccagtccgcttgccaatagatcaaagatcgcttgagcacccgcagtacttgtgaaaaagtttanaaatatgaggcctangagaaggtgtcctaagaagatggccaanaagacccattnccatacanctnttgtcnattg

SEQ ID NO: 2603 - DNA, 707 bp, Homo sapiens
  misc_feature (1)...(707): n = A,T,C or G
naccncgatcgaatccgtgctgtcgccggcctcctatgccttctttccgggcctgttttaagagcattttcagaatacacacagaaacaggcaacatttggacacatctcttaggttgtgtattcttcctgtgcctggggatcttttatatgtttcgcccaaatatctcctttgtggcccctctgcaagagaaggtggtctttggattatttttcttaggagccattctctgcctttctttttcatggctcttccacacagtctactgccactcagagggggtctctcggctcttctctaaactggattactctggtattgctcttctgattatgggaagttttgttccttggctttattattctttctactgtaatccacaaccttgcttcatctacttgattgtcatctgtgtgctgggcattgcagccattatagtctcccagtgggacatgtttgccacccctcagtatcggggagtaagagcaggagtgtttttgggcctaggcctgagtggaatcattcctaccttgcactatgtcatctcggaggggttccttaaggccgccaccatagggcaagataggctggttgatgctgatggccaacctctacatcacangagctgccctgtatgctgccccggatccccgaacctttttncctggcaaatgtgacatctnggttcactctcatcaactggttcn

SEQ ID NO: 2604 - DNA, 704 bp, Homo sapiens
  misc_feature (1)...(704): n = A,T,C or G
tgcttgcaattaaattcnccgtctcagttcaagagtgaatatagcaacttatgtgaacctgagcagtttgtggttgtgatgagcaatgtgaagagactacggccacggctcagtgctattctctttaagcttcagtttgaagagcaggtgaacaacatcaaacctgacatcatggctgtcagtactgcctgcgaagagataaagaagagcaaaagctttagcaagttgctggaacttgtattgctaatgggaaactacatgaatgctggctcccggaatgctcaaaccttcggatttaaccttagctctctctgtaaactaaaggacacaaaatcagcagatcagaaaacaacgctacttcatttcctggtaagaaatatgtgaagagaagtaccctgatatactgaattttgtggatgatttggaacctttagacaaagctagtnaagctntgtanaaacgctggaaaagaatttgaggcanatgggaaggcagcttcaacagcttgagaangaattggaaaccttttccccctcctgaggactttgcattgacaagttttnggacnaaagatgnccaagatttgttatcnagttgcaaaaagnacaaatatgagacacttttcgaagtttacacgaaaacnntgggaaaagttattcccgaantttaataggnatacttttgcccatngatttgaaaaaagg

SEQ ID NO: 2605 - DNA, 743 bp, Homo sapiens
  misc_feature (1)...(743): n = A,T,C or G
nnagatcagctcttgttctttttgcaggatcccatcgattcgggatcctccaggctgccggctgggaaggcgtgggcgacccggtgtgtggcgcgcccagagccccgcgtttcagccctagggaaggaagccagttgagggaagttctccatgaatgtacgtcacaatgatgatgaccgaccaaattcctctggaactgccaccattgctgaacggagaggtagccatgatgccccacttggtgaatggagatgcagctcagcaggttattctcgttcaagttaatccaggtgagactttcacaataagagcagaggatggaacacttcagtgcattcaagatgaagtggtgaagagagcctgcgattgaagattttttcatctcagctttttcccccttaccttgttctctctcatgtttcatgatctgtgtcatagatatttcttcattacgagcacttcgcggtgtggcttttcaatgtctgaagtggattaagtggcccacagtcagttctgtgacttgagtttcaaaagtnaaattaccatcaacaatgtgattcaattttattttctatactagctaaaagcaaggaactatattattaacaatcttggctttactgtagtttaaggcaggtgatgatgatgcttattagtccacctgaaagagtccttccangtttttggaaccttattcctgcttattaccttgcccttgaaaagtccttcatggaaagtggaat

SEQ ID NO: 2606 - DNA, 675 bp, Homo sapiens
  misc_feature (1)...(675): n = A,T,C or G
attcanatacanctacttgttctttttgcaggatccctcgattcgggatcctccaggctgccggctgggaaggcgtgggcgacccggtgtgtggcgcgcccagagccccgcgtttcagccctagggaaggaagccagttgagggaagttctccatgaatgtacgtcacaatgatgatgaccgaccaaattcctctggaactgccaccattgctgaacggagaggtagccatgatgccccacttggtgaatggagatgcagctcagcaggttattctcgttcaagttaatccaggtgagactttcacaataagagcagaggatggaacacttcantgcattcaagatgaagtggtgaagagagcctgcgattgaagattttttcatctcagctttttcccccttaccttgttctctctcatgtttcatgatctgtgtcatagatatttcttcattacgagcacttcgcggtgtggcttttcaatgtctgaagtggattaagtggcccacagtccagttctgtgacttgagtttcaaaaagtaaaattaccatcaaccaatgtgattcaattttatttttctatactagctaaaagcaagggaactatattattaacaatcttggctttactgtatttaaggcaggtgatgatgatgcttantaatccccctgaaaa

SEQ ID NO: 2607 - DNA, 756 bp, Homo sapiens
  misc_feature (1)...(756): n = A,T,C or G
ntccccccatcggacctccagctgccggctgggaaggcgtgggcgacccggtgtgtggcgcgcccagagccccgcgtttcagccctagggaaggaagccagttgagggaagttctccatgaatgtacgtcacaatgatgatgaccgaccaaattcctctggaactgccaccattgctgaacggagaggtagccatgatgccccacttggtgaatggagatgcagctcagcaggttattctcgttcaagttaatccaggtgagactttcacaataagagcagaggatggaacacttcagtgcattcaagatgaagtggtgaagagagcctgcgattgaagattttttcatctcagctttttcccccttaccttgttctctctcatgtttcatgatctgngncatagatatttcttcattacgagcacttcgcggtgtggcttttcaatgtctgaagtggattaagtggcccacagtcagttctgtgacttgagtttcaaaagtaaaattaccatcaacaatgtgattcaattttattttctatactagctaaaaagcangggaactatattnttaacaatcttggctttactgnangtttaaaggcaggtgatgatgatgcttattaantcccaccctggaaagaagttcccttcnnggttttttggaagcttttatttcctgctttaattaacctttgcccccttggaaaaagtcctttcattgggaaaagnggggaaacanctgnggtttgacnc

SEQ ID NO: 2608 - DNA, 732 bp, Homo sapiens
  misc_feature (1)...(732): n = A,T,C or G
gnnnnnttctaatacnnggctacttgttctttttgcaggatcccatcgattcgaattccgttgctgtcgctaccattgcaagaccccagattgcaagggatggtgcttctttgaggatgatgtcaatgagttcacctgccctgtgtgtttccacgtcaactgcctgctctgcaaggccatccatgagcagatgaactgcaaggagtatcaggaggacctggccctgcgggctcagaacgatgtggctgcccggcagacgacagagatgctgaaggtgatgctgcancagggcgaggccatgcgctgcccccagtgccagatcgtggtacagaagaaggacggctgcgactggatccgctgcaccgtctgccacaccgagatctgctgggtcaccaagggcccacgctggggccctgggggcccatgagacaccagcgggggctgccgctgcagggtaaatgggattccttgccacccaagctgtcagaactgccacttgagctaaagatggtggggccacatgctgacccagccccacatccacattctgttagaatgtagctcaaggagcttcgtggacggccttgcttgcttgtaancgtttgtaagggccctgcctgcactgcggttgtcacggtcacatctgccccaatgcctttgtccttccttggggcttgccggcagactttntatccctgcgnttccaacctntgctgaccccagcttaaacat

SEQ ID NO: 2609 - DNA, 793 bp, Homo sapiens
  misc_feature (1)...(793): n = A,T,C or G
tcttcntcgaattncgtgctgtcgctaccattgcaagaccccagattgcaagggatggtgcttctttgaggatgatgtcaatgagttcacctgccctgtgtgtttccacgtcaactgcctgctctgcaaggccatccatgagcagatgaactgcaaggagtatcaggaggacctggccctgcgggctcagaacgatgtggctgcccggcagacgacagagatgctgaaggtgatgctgcagcagggcgaggccatgcgctgcccccagtgccagatcgtggtacanaagaaggacggctgcgactggatccgctgcaccgtctgccacaccgagatcttgttgggtcaccaaggcccacgctggggccctgggggcccangagacaccaacgggggcttgccgctgcagggtaaatgggattccttgccacccaactgtcaaaactgccactgagctaaagatggtggggccacattgctgacccaaccccacatccacattntgttanaatgtagcttaagggagcttcgtggacggccttgcttgctgtaacgttgtaaggggccctgccttgcactgnggttgtccacggtcacattttgccccaatgcctttgtcctttccnttggggcttgccggncaaaactttttttncccttggggnttcccaccttttgncttganccccaancctttaaaaaataanccccctgggccaaaaggccttttcnttgggtngggaanccctnttggggggaactccattaanttctttcccaancanaaaaaaaa

SEQ ID NO: 2610 - DNA, 767 bp, Homo sapiens
  misc_feature (1)...(767): n = A,T,C or G
gnnnnttnnntttatanatacaagctacttgttctttttgcaggatcccatcgattcgaattccgttgctgtcggcggggaggacgtaccttgtgagatgcgagccggccaacagcttgcaagcatgctccgctggacccgagcctggaggctcccgcgtgagggactcggcccccacggccctagcttcgcgagggtgcctgtcgcacccagcagcagcagcggcggccgagggggcgccgagccgaggccgcttccgctttcctacaggcttctggacggggaggcagccctcccggccgtcgtctttttgcacgggctcttcggcagcaaaactaacttcaactccatcgccaagatcttggcccagcagacaggccgtagggtgctgacggtggatgctcgtaaccacggtgacagcccccacagcccagacatgagctacgagatcatgagccaggacctgcaggaccttctgccccanctgggcctggtgccctgcgtcgtcgttggccacagcatgggaggaaagacagccatgctgctggcactacagaggccagagctggtggaacgtctcattgctgtagatatcagcccantggaaagcacaggtgtctcccactttgcaacctacgtggcaaccattgaaggccatcaacatcgcaagattaaacttgcccgnttccgtgccccaaaaactggccggatgaaacaagnttaatttctgtcattncaaggaacatgggccnttccggnancacctn

SEQ ID NO: 2611 - DNA, 949 bp, Homo sapiens
tggaaactatgtccctgcacccaaagaaggttcttttgaactttatggagaccgagtcctgaaactgggaactaacatgtacagcgtgaatcagcctgtggaaactcatgtgtctggatcatcaaagaacttagcctcatggacccaggaaagcattgctccaaaccctcttgctaaagaagagctgaatttcttggccaggctgatgggagggatggagattaagaaacccagtggccctgagcccggattccggttgaatctctttaccaccgatgaagaagaggaacaagcagcgctaaccaggccagaagagttatcctatgaagttatcaacatacaagccacccaggaccagcaacggagcgaggagctggctcgaatcatgggggagtttgagatcacggagcagccaaggytgagcaccagcaaaggggacgatttgctcgccatgatggatgagttatagctgttctgaccaggcgtcctctgcccccagggagaggctgctggatggtgacccctggggaatgccccatggcccagaatgatgctgctagttttctactgagtgaagccattacgtctatttcttatttatgttgtaaggaactgtgtgagtctcccttgaggagcactcactcttgaaggcacacacatacacatattttcagtgaaatatattctgacttttaaacttgacctttcccattttattcttaattctgaggcaggagaatcgcttgaacccaggaggtggaggttgcagtgagccaagatcatgccattgcactccagcctgggcaacaagagcgaaactctgtctcaattaaaaaaaaaaaaaagaatataaatcaccaaataaatgttaattgctccctacccattaaagttacacttccttacctataaagacaacctccccctccacatactcacggaaaagtct

SEQ ID NO: 2612 - DNA, 293 bp, Homo sapiens; identical to SEQ ID NO: 1303
  misc_feature (1)...(293): n = A,T,C or G

SEQ ID NO: 2613 - DNA, 534 bp, Homo sapiens
  misc_feature (1)...(534): n = A,T,C or G
aattcgttgctgtcggaagttattgctttccaggggtcactctggcttcgactccgtcgctctcaattcgtcaccrggaggaagacggagctggctgcccagcccaaaggcccatgaggggatgcagttatgggctctgtcgccgtggattgttattttgtgtcagtaagtaatccatawwgtgccaacatgggaaagaaacggwcaawgggaaaaactgttccaatcgawgattcctytgaarctttaraacctktgtgyakacacattagaaaaggattggaacaaggtaatttgaaaaaggctttagtgaatgtggaatggaatatctgccaagactgtaagactgacaataaagtgaaagataaagctgaagaagaaacagaagaaaagccttcagtttggctgtgtcttaaatgtggccatcagggctgtggcagaaattctcaggagcagcatgncttgaagcactatctgacgccaagatctgaacctcactgtctggttcttagtttggacaactggagtgtatgg

SEQ ID NO: 2614 - DNA, 454 bp, Homo sapiens
  misc_feature (1)...(454): n = A,T,C or G
aattccgttgctgtcgggacatgaaggcctgccaggaggacgatgtgcggctcctgtgccacctcacgccctccatctacacagagtttccagatgaaaccttgaggagcggagagctgctgaacatgatcgtggctgttattgactctgcacagctccaggagctggtctgccacgtgatgatgggtaacctggttatgtttcgaaaagactcagttctcaacatactcattcagagcctagactgggagacctttgagcagtattgtgcctggcagctctttctggcccacaatattcccctggagaccataatccccatcctgcagcacctcaaattacaaggagcacccagaggccctgttcctggcctactggcttncaacttccggaaggaggaaaaagncccaggcgaggggagatgggtggaaggtgngtagctgaaggccgggcc

SEQ ID NO: 2615 - DNA, 592 bp, Homo sapiens
atttttagtttttcgagtacaccgtcccagaaagaaatacgctataacacccaccagcctgagggctgcattgctgtggaagcaggaatggatacccttatcatgcatctctgcgaagawwctgatsmcywgmswrtcakwmkktyatcttgywgkaggatggatctttatttcacgaacagtccaagaaatgtgtccaggctgcgaggaaggagtcgagtgacagtttcgttccactcttacgagactgcaccaactcggatcatcagaaatggttcttcaaagagcgcatgttatgaagcctcgtgtatcaaggagcccatcgaaggagactgtggagccaggactctgcccaacaaagacttagctaagcagtgaccagaacccaccaaaaactaggctgcattgctttgaagaggcaatcattttgccatttgtgaaagttgtgttggatttagtaaaaatgtgaataagctttgtacttattttgagaactttttaaatgttccaaaataccctattttcaaagggtaatcgtaagatgttaacccttggtatttagaaaattaaaaccttataatatttttctatc

SEQ ID NO: 2616 - DNA, 682 bp, Homo sapiens
aattccgttgctgtcggctggtggcaccctcccctgggccggaagactgggaattcctgctaagtgtggcttctagagtgtttgtgtgtaccccgcttctgactgcctagggcgagtgggcatcctgtcatcatctccactgtcccaagcagtcactaggtggcggccgggccagctggaacccagcccatcctctcaggcagagcagggtggtccgggcacactgggcctgcctctccagcctcaggatgctcttgtttattctgggctcagaccctcctcttgtacgtctcatcacagctggtagagacccaggagtgcctgattktcccacaggggtggcgcacagctctgggaccactcagaagatgggatgtgtgggtggaggatgccttgtctcggtcagctcattcctgcctccttcctgagccagttcagggcctgggggagagccagcttggggtaggaagttaataatactgttaatttgggttgttgttggatttactttgctagattttctctttcaccacgtgtgaactgtgggtgaggtttcaaagtagcttcaccccacgtggcttggttcccagggacagtcaggcctcgggggcccagctatgtacaacgaagctgtcgaaggagaagacaataaagtcgtccgcagctgctctgtgtgtttctc

SEQ ID NO: 2617 - DNA, 581 bp, Homo sapiens
aattccgttgctgtcggaaagttcgacacagcaaactggctgagtctgtggaaaaggccattgaagagaaaaaataccttgctggggcagacccttctactgtggaaatgtgttaccctcctatcattcagagtggtggcaactataatctcaagttcagtgtggtgagtgacaagaatcatatgcactttggggctatsacttgtgccatgggtattcgcttcaagtcttactgctccaaccttgytcgcactttgatggttgatccttctcaagaagttcaagaawattataactttttgctccagcttcaagaggagctgctgaaggaattaagacatggtgtgaagatatgtgacgtgtataacgctgtcatggacgtggttaaaaagcagaagccagaactgctgaacaaaattaccaaaaacctagggtttgggatgggaattgaattcccgtgaaggctccctagtaatcaatagcaaaaatcaatacaaacttgaagaaaggaatggttttcagcatcaatttaggattctccagacctgactaacaaggaggggaaaaagccagaagagaaa

SEQ ID NO: 2618 - DNA, 594 bp, Homo sapiens
aattccgttgctgtcggcactggtggcaagaggctgctgatccccgttgtgcctggtgtggacagcctcaactcggccatggcggcaagcatcctgcttttcgaagggaaaagacagctgcggsggaggtctgggaasttgagcagggacaggagttaccactgaggacgcagaagtgacttctgcttgaggacgtctgcagctcctcctacaccagcacactggtgggaggctggcggagtcagtgactatggcccccacgttcaggaggaaggtgtgatgccgtcatacagttacaggaaaaataagaacttcctcagaaagaacaggtccgaattcttcctgtcgcgtcactgattttgaggttcttttttctcttggtgacaataggtgacccacgtggctctgtgtgtttttaaaaattgtccaccaagaagcactttgtscycagaaagttcctgaagcatcatcctggcagggaggcgcctgctccaccagctggtgggtgtttgtaatcgccaagcaccagctataggtcacagccacatcactcacagctgatcactggttggtggaaaataaactatgagcagc

SEQ ID NO: 2619 - DNA, 859 bp, Homo sapiens
  misc_feature (1)...(859): n = A,T,C or G
aattccgttgctgtcgggttgttgaaagtccagatttttccaaggatgaggactacttaggaaaggttggaatgttaaatggaggccgccgaattgactacgttctccaagaaaaaccaatagagagttttaatgaataccttttcgctcttcagagtcacttatgctattgggaatctgaagatactgctctgttactacttaaagaaatttatcgaacaatgaacattagtccagaacagccccagcattgatcaaacttcagttttactgtactttcttgtctgcacagaaagtcccagtacaacttccattgctgagaaaatcctcagaggactttcccacttcgctcctgtgatggatgacagaagagtgattcattaacaattgctcagccacaattctcggatatagggattcaaaagacaggayacagaactaacacagtgaaaaaaatcagtaccacatttggacagtataggtgagaaaacataattataaaaatgatgccatgaaaaattccacagatcagtttagttgtatagttgtcaaagttatatgtgatatcaatgaagaaatatttgtagcatgtaaacggttatttctgtttcttaaaaagtattgttartgggctattaaacttggatttttctttttattaatgcagtatgtnctttttatycaagtatgacttgttgagaactatagtaatatgatttttaagagatttatgttcncttaaaatgtgaattgtacttctgagctgcttaatcaggycatttatatttgttaagaggaataccagatcactcatatcccactgaatctgaggtttataatcccnccaacgatgctggng

SEQ ID NO: 2620 - DNA, 988 bp, Homo sapiens
aggcgcggtgccccagagtggggtgcctgcactctcagcttccacaccctcaccctacccctacatcggacacccccaagyatgtmggswsgssrgaagccacagtcgccgccgccagggscttgctcctggctctgtcctttgcttccctccgtcctcgctcagttgtgatccagcagcccccctccccactgcctccccagctctcagtgaccccgactgtctcctgacttagccgaggtaaggtcagyscmgcagacagggccagaytgrggwgtgssgskcykwscyrgrcacatsmsysasgscyctggcttactgggaaacagcgattgacctgtgcttctgacagcccccgagacaccttgaggaggccgctccttcccagacacacccccacgcccccactggacggcattggaggaagggacagctgcttgggttctaatgctcctgctctcttctcttttcccctccaaccagttcaatctcatccctcccagcagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaa

SEQ ID NO: 2621 - DNA, 854 bp, Homo sapiens
gccccaaggagtgctagctgagggtggttgctggggtggtcctcatggacagtgaggtgtgcaagggtgcactgagggtggtgggaggggatcacctgggttccaggccatccttgctgagcatctttgagcctgccttccggtgggagcagaaaaggccagaccctgctgagttaaraggctgctgggatccactgtttccacacagcgggaaggctgctgggaacaggtggcagagaagtgccatgtttgcgttgagccttgcagctcttccagctggggactggtgcttgctgaaacccaggagctgaacagtgaggaggctgtccaccttgcttggctcactgggaccaggaaagcctgtctttggttaggctcgtgtacttctgcaggaaaaaaaaaaaggatgtgtcattggtcatgatatttgaaaaggggaggaggcccaagtttttcccctttatccagtgattgggaaattatttgacccccttggctgaattcttttgcagaactactgtgtgtctgttcactaccttttcaggtttattgtttttatttttgcatgaattaagacgttttaatttctttgcagacaaggtctagatgcggagtcagagatgggactgaatggggagggatcctttgtgttctcatggttggctctgactttcagctgtgttgggaccactggctgatcacatcacctctctgcctcagtttccccatctgtaaaatgggagaataatacttgcctacctacctcacaggggtgttgtgaggattcatttgtgatttttttttttttttttgtacagagcttttaagcattaaaaacagctaaatgtgaaaaa

SEQ ID NO: 2622 - DNA, 637 bp, Homo sapiens
  misc_feature (1)...(637): n = A,T,C or G
ctacggtttcccgtcaccaattttccttggaattggacagatggcagccaccataatgatactatatgtgtccaagctaaacaaaatcattcacttccctgattttgataagaaaattcctgtaaagctgtttcctctgcctctcctctacgttggaaaccacataagtggattatcaagcacaagtaaattaagcctaccgatgttcaccgtgctcaggaaattcaccattccacttaccttacttctggaaaccatcatacttgggtgawkywgkwttymctcaacatymtyctcagtgtstttgccattattctcggggctttcatagcagctgggtctgaccttgcttttaacttagaaggctatatttttgtattcctgaatgatatcttcacagcagcaaatgggagtttataccaaacagaaaatgggacccaaaggaggctaggggaaatacgggagtaacttttttctwacaatggcctggctttcatggattattccccaacttctttatttatttaggtggttcttcccactggtagggacctggccaaccagggcttacngggaatttccaacccatgggggtgggattgttggtggttttnattccncaacagttttcttnctt

SEQ ID NO: 2623 - DNA, 300 bp, Homo sapiens; identical to SEQ ID NO: 94

SEQ ID NO: 2624 - DNA, 923 bp, Homo sapiens
gaaagaactccctggctgtagctcctatgtaggttwaggttgagacyctggattccaccaatttttaaaggttaccatctgaggtttckratcatagtctacttttgaagcagctgctgctrtttctttattccattgaacaccctggaattgacataattttatctatcagcatttctccccttttagtttatttaataattaacccggtctccagggcagttttcatatgaccatgtgtatattcactgctcacgaawaagtttaatgttagattaccaaatttaatatagttacagaattactgcataagggcttcccttcttggagactcttacccagcatgggaacagtgatctgcccacatgacagggtggtatgccaggcatagttaactgcttttggttgtgaggtactcatcttcctttagttacccttagttatgtggcacacatgtccttattgcctagttcgtcatccacactttggatcttgtgaaaatgctgttagtatccaaccttaaaatatattagtatatgggtttttattaaaagaattactttgaattttctatttaattcatatgtaaataaaggaacatttcatttcacttaaaaaaattatatcagttattaggctgggtgcagtggctcatgcctgtaatcccagcactttgggaggccaaggcgggtggattaccagagttcgggagtttgagaccagcttgaccaacatggagaaaccccgtctctactaaaaatacaaaattagccaggtgtggtggcgcatgcctgtaatcctggctactcaggaggctgaggcaggagaatcgcttgaaaacccaggagacagaggttgcggtgagctgagattgcgccattgtactccagcctgggcaagaagagcgaaactctgtctccaaa

SEQ ID NO: 2625 - DNA, 1125 bp, Homo sapiens
  misc_feature (1)...(1125): n = A,T,C or G
aattccgttgctgtcgcagacaccttctcctatggtgggcatgaagacttttcaaaaatgattgatgaagctgagcccctgggctacccagtcgtggtgaagagcacacgaggccaccggggaaaagctgtttttctggcaagagataaacatcacctctctgacatctgccatctgatccgccacgatgtgccctacctgttccagaagtacgtgaaggagtcccatggaaaggacatccgggtggtggtggtagggggccaggtcataggctctatgcttcgctgctccactgatggacggatgcaganaacatgctcgtctcggtggcgtgggcgtcaagtgtccgctgacagaacaaggcaagcagttggctattcaggtgtccaacatcctaggcatggacttctgtggcattgatctccttatcatggacgatggctcctttgtggtgtgtgaggcaaatgctaatgttggcttcctagcctttgaccaggcatgcaacttagatgtgggtgggatcattgcagactataccatgtccttgctgccaaataggcagactggaaagatggctgtcctcccaggactgtcgagtccaagggagaagaacgagccggatggctgtgcttcagctcagggagttgcagagagcgtctataccatcaacagtgggtctacctctagcgaaagtgagcctgaactgggagagatccgggattcctcagcaagcacaatgggggccccaccctccatgctgcccgaacctggctacaacattaacaacaggattgcttctgagttaaaacttaagtgaattcctgctttttggcagcatttaaaccaaatcctactgcttccctagtagttttgagtgaataaaatctggactaatgtgatttcatttgcacagaaactagaaatcccatctgggcactcagcatttttyctaacgatgatttaagcaaatggcctagctttgtggtttttacaaagacaaatataaaaacactcacaagnacaacgtcccgactgancaatatgagactgatgtctgctgtgagcacgtggatattacggctgacgctaaggcactgnctctgctgttgcttctgacttttagca

SEQ ID NO: 2626 - DNA, 620 bp, Homo sapiens
aattccgttgctgtcgtggaggcttactaaccaggtaagccttctatgcatccacaccaaaatcctgcagaatgtaagtaagctctgctttataagatgggttcaccttcatcgcagactgaaagtttcagtttttatttttttcagaaagcacgaaaaattatttataatagtctggagaaaaaaacacactgtaatatttcaagtgtatgccagtagaatgtactgtaactgagccctttcccacatgtctaggctccaatgtctcctgtaggtccacctaactgtgtgttttcagggacaatgccatccatgtttgtgctgtagacttgctgctgctgaatcctttctggggactttctcatcgggcagggagcagagggcttctcgttcatgcaccctttgcctgaacacccatgtagctgctgtgttgtgtatatattactcttaagaggagtgtgtgtgtctgtgtttgttttaaaagtcacttatttcttacagtgatttcaattgcaccatgacttcttcactaaaaccacaaagtcctgcttaaaactatggaaaacctaacctgattagagccttgactattttgaagattaaatgcacactttttatat

SEQ ID NO: 2627 - DNA, 573 bp, Homo sapiens
gtttatgggtttacattgtcatgtctccacaggacaatgcacatggtatgtttgtcagaacccagttggagttttgtttcccagcatccaaaggaaatccctaactttcattttttcttcccgtaagccagccccgaacacttaccttataagcccatctctacctgaattagcaatcatggataagctcaataactgatcatttccttatccagtttaaaccatatatattttaacactgtctctttttcacacacactagttagctaagaatgagctggggggctgggcgtggtagttcacgcctgtaatcccagcactttgggaggcggaggtgggcggatcacttgaggtcaggagtttgagaccagcctrgctaacrtggtgaaaccccgtctctactraaaatgcaaaaattagctgggtgtggtggcaggcatctgtaatcctagctactcrggaggctgaggcrggagartcccttgaacccgggaggcagaggttgcagtgggccaagatcacaccactgcactccagtctgggtgataaaacgagattccgtctcaaaaaaaa

SEQ ID NO: 2628 - DNA, 539 bp, Homo sapiens
cttctgtagatactgaagaaacaattgaaccttatacaactgaaaagatgagtcgagttcctggaggatatttggctttgacagagtgctttgaaattatgacagkarawwkcwrcaaymtycaggtgtttactacaatctggaggcaagatctttcctcagtatgtgctgatgtttgggttgcttgtggaatcacagacactcctagaggagaatgctgttcaaggaacagaacgtactcttggattaaatatagcaccttttattaaccagtttcaggtacctataccgtgtatttttggacctatcctcattgccctgtatacctttaagcaagccagtggaactcttaagactagatttaatgactccgtatttgaacacctctaacagagaagtaaaggtatacgtttgtaaatctgggargacttgacttgctatttccattttgggkatcatatggtacccttgaaggaggtttagggttgggtacttycagtggaggcctcccmctgggaaaccaagctggcagtttgttt

SEQ ID NO: 2629 - DNA, 672 bp, Homo sapiens
  misc_feature (1)...(672): n = A,T,C or G
aattccgttgctgtcgataaaataatgcatgtaaggccctcagcatagtgcctggcacagaattactgctcaaatgttagctgtcgtattaatattgksacktttgcacrckkatgtacatttsctgttkatsyakgctcattctttaagcattctccatgcttaaaccagttccataatccctaggcctgtactccagggattgagactgaaaggatcatttatgccatgtttctctaaaagcatcattgctggaagacttttgataagtctgatgtgtctcaagctattctcargccttttttgtagagtttagaaatgaagtatttgaatcaatttagtatctcctttactatgtttctccttttaatctcagccaacccccwacctgcaggtaaacccagcattcattaagagctgggttggggtactctattctgtatgcatcataatagcttaacattatttagtagctgtaacttacaggtttaatgctagatgaggatgtctcaagccgtgagtgtgcttgtgtaaaaatggtggcaacatcatctcgttggtaggaattttttacttgaattgttattttgggaaaatgttaacagatttcttggataaagaaaatnaattggatgatgtatattttatgtttccttttagcctctcttaaaa

SEQ ID NO: 2630 - DNA, 424 bp, Homo sapiens
  misc_feature (1)...(424): n = A,T,C or G
tgtaggcacaagattttcttgctagcggaatgtgaaccaaaaagtgtagaggccaatcagtaaaaatattcaaagccagttttgttgttttcagcagttagtaactatcagtagatgaatatttactaggaaacattggtcttttaaccactttgggcatgcttcttatttagtatgttcatcatgatttagtatcatgacattcagcgaacatttattgagtgcctactgtgcactagggactagtaagcatgttaagtttgtaagctttgttgatttccaccacaaacccataggacctcaggttantctcataattgaggaaactgagattcccagtgttgaatgaaagccacacagtatcacatggccaatatcatgtgattgcagagtcaggactcaaacccagctcttaaccnccacg

SEQ ID NO: 2631 - DNA, 300 bp, Homo sapiens; identical to SEQ ID NO: 143

SEQ ID NO: 2632 - DNA, 908 bp, Homo sapiens
  misc_feature (1)...(908): n = A,T,C or G
cttaggactgggtcttggggaggattagcgcctagatgtctgattttggagctgcagcatgccaggccgtggctgagagtatgtgagccatgccttgcccttttctgaggctcagggaagtggatggagctagagagacaacaggaaagacggtgctgaagaacatagtgtctttcctctattgtggacctaaagaggtggggaagcaaggacaagaggcaaagagccacactgcccttggcatcatccaaagcattgtctggttgacaccaggtcctggttttgtgtcttttgtcaatacctgaatccttgacaaaagaaaaagtggttttgatgatttaaagaaataagggtgattttracagaaaatatattttaaaaattttraccamttgcaatagttatcctcaagccaatttccagaacctgccaccagggggaggtggtgcagcatgaatcattctgaatgctttgtctttgaagtgttcccctattgctgttaccatctcagaggaagtaactgggcatggtgagactcctaaaatgaymggagtttttttggccaaagctggcatctgacttgccacattcctctgagtctggagtagccgcagggtgggagaatgccagcccagagtcagtccatcggggttacatttccaaggtctgctgccttcatctatgtaatggccgtgttactttcagatctttcagcttcccagagtgttgtgggaatcttggtcattgaatgtaaagggacttagtaaagggtatagatatttttcaaaaatgaaaataacttttgttcttataagtgataagctnttataaagatcanaggaaaactngaaaaaatgtaaaatgtaggacaatttgtanaacaaacttgcattngagatgtttttgat

SEQ ID NO: 2633 - DNA, 476 bp, Homo sapiens
ggaaggactacggatccgcaggaagaggcagttgggggccaggggcccagtagaggaggctgagctccttccaactcctcagaacctccactctatggatctggacctctggattcggctttctccctgggcactgccttcaggaagacgttgagaattgaccttacacaatcccagcgccctcctcacaggagcctttcactttacagtggcaaggggctggttctggagaactggctgatgctctgaatttcttcatataccccacatttgactttggcttacactgtacaattggagatgttgctacaggtccctggagatgcaatcagattaagcgtagaaagcattgccaattgggaaagtcaaaataatttattttttttccctttcccctaccccatccccagccaagatttctttcaagatatcgcatcattcttaacaacattcttacccccactgggtccccattt

SEQ ID NO: 2634 - DNA, 1648 bp, Homo sapiens
  misc_feature (1)...(1648): n = A,T,C or G
aattccgttgctgtcgcactgatttactccctctcttccccactccctgtgaggctgggctgaggcacggatccctgggccacagagcaagtctccaaatcagacagctgcctcagcccctgggatgtgtgatttcagctcctgtcacctcatgcaagggcgtggagaccagtagaggtgtggaggccaggcagagagaggagccygctctgmgggrkgcccagctcatgggcactgycccttcagctagcctgcctmcgtcccctgagtccaacagtgggagccctagctgggaagttctgatccccaaagccacagcaggggactgatggctatagcagaatgaggtcgggtcaggaccctcaaacaccatctgggaacaccaagcaccctgaatcgagactgcaggagccctgcggggtgagactgtgtcagagatacactgctggccacaagtgtcccctctcagtcccaccttttcgggctgtcccatgtctatctcaggggcccgttacctctctgcagcagtcccccatcccagccacaccagggtctgtccggccaaccctcttccccagggaaaggagaaaagagaaaacaggctgggcccggtggctcactcctgtaatcccagcactttgggaggttgaggtgggcggatcacctgaggtcaggagtttgagaccagcctggccaacgtggtgaaaccccatctctactaaaaaaaattacaaaaattagccgggagtggtggtgggcacctgtaatcccagttactcgggaggctgaggcaagagaatctcttgagctcaggaggcagaggttgcagtgagctgagattgcgccactgcactccagcctgggtgacagagggartccgtcccnaaaaaaaagaaaagagaaacagctgtcacctcccgcagacccaaatcctctctctgagcaccgtcatccaccacatggctgggcctggctcccaggaccagtccagtcctctagtgccttatctgaggctgcagcgccagtctccaccccaaggagacagcccctgctcctagatgcccttggcctccgcagtgcagcccccaggtgtcctgactgaagcacaggccatagccccatttccccggtgcctgcagggctaacctccacgggagcccaggagctctggccggcagtccatggcacagggcatcggaagactgcaaaactgctggacttaccctgggctgcagtccattgtcggcccctgggttgaatcaagatagtacttgcagctagatggatgcttttagccaggggacattgtgaggggaagattcctccacccagtctggcctgtggtgtctgtctcctccctgagaccacagcttctccagtagcagactcatgggcgccaccaagtggaagcacctggagcggcctctgccatccagtggaagccaggccccgagacggaggtgggggcagcacgtgcctccacagccaccgctttcccgcctcagcagcccaggcctcctggcccagccctgcctgggacagtgctytyccctcacccgggaagntnggaatyctcctgcccgagaggaaggcagacggcacagggacaaccytgccacttgggattttggcttncaagttggttttt

SEQ ID NO: 2635 - DNA, 956 bp, Homo sapiens
  misc_feature (1)...(956): n = A,T,C or G
agaatacaagccaaaacatggcttcaaaaggtcagctgcatcttcactggattacagaattcttgctgactctcagaagaaattgttggagagaatagtcatacckrcwykagmwrgagaataaatwgcctttcctaaattcctctgcttcgctcctttcctggcgttgctctggaaccttgttggtgtctgtgacccaatgactgttagggtcagctagcttcaattgcccctgcactggaagcaaggtttgtcagtaacaccaattaaaatactaccagtgtaagtagaaggtgtgttttgcagatgagaaggtgctaagatgccttgcttatgttctctgtgttgctgtaataccatgaggggtatgttgtggcaaacctggcctttragatcaagacgaaccccacctgccctgagaagccgtctgctaccaccacagcctacccgaattggkcctgtcccctaaacccctcacactgagaactgcttgtgtgggagagagctggttgggttgatcttttccgagtgtgacttacctccttcaaggggatgtttaagcttctcgggcagaagtggtgtgtctattcctgacaccaaacaccgtggtatatgtggttgtcacactcagctagtgatgataaaggtgttcttaaatatgttagctttcagttttcctgaggaagcaattttatggatacttccccctccttctcaagtgaggaatagcagagcaaattttatttggaacttaaaccaatagttataaccaatagtttcaacctcctgcctcaccactgsttccttcctgagctctttccccacacctcaaaaagagtacaaagtgattccatctgcagaggtaaattctttgtttaaaaaagtactgtttttcttatcttttctggntctcctaggtatcagaacaaggtttattaggaatccttaaaaaagta

SEQ ID NO: 2636 - DNA, 300 bp, Homo sapiens; identical to SEQ ID NO: 163

SEQ ID NO: 2637 - DNA, 903 bp, Homo sapiens
  misc_feature (1)...(903): n = A,T,C or G
aattccgttgctgtcgaccccaaccctctctcatgttcagtctgtctaatacatgccagagatttttttttcaaaaagtgctttatccctacaatgtactgacagttcttacagttgagatttgttcttttcagctattgcttgtgaaaaaaagcaagactatgtcactctatagaaggctgttaaagtgactcaggcaggaattaattattctgtacctaaggggttacttgtttaatgggatggcattgactttttgaaaatcaagtggactgagtcattgataaaacatttctaagagtggggctagagaacatactttacatctgacatcctttggcctaacaacatctattattatagtgctcagcagtgtgggcattgaagaggcgcagaatgctttgaaagaaactaatcagaatcttggaacatcatgatcatgccattcttaagtaaatcaactattttcaacactgaagaaaaatgaaacattatttagaaaacaatgagattacaagttccaaactcagccaggaatgtggctcacacctgtaatcccagcactttgggacacctaggtgggagcatcgcttgaagccaggagttcaagaccagcttgggcaacgtagtgagacccctatctctacaaaaaataaaaaaattagctgggtgtgatggcacacacctkttgtcccagctactcaagaagctgagatgggaggwtcctgagctcaggaggtcaaggctgcagtgagccgagattgttgccactgcaytgcagctkggggtgacagttgcaagaccctgttttcaaacccaaacccaaacccacacacacacaaacacacnttwcacacacacacacacggggttcccattggttggccggggtttccccagggg

SEQ ID NO: 2638 - DNA, 524 bp, Homo sapiens
aattccgttgctgtcggcgcggaggagaagtggcgtcgagtccggccgggcagtagaggaaattgcggtagtgaccctcgggcctcgcmatgaagagccgctttagcaccattgacctccgcgccgtactcgcggagctgaatgctagcttgctaggaatgagagtaaacaatgtttatgatgtggataataagacataccttattccgtcttcaaaaaccggactttaaagctacacttttacttgaatctggcatacgaattcatacaacagaatttgagtggcctaagaatatgatgccgtctagttttgccatgaagtgccgaaaacatttgaagagtcggagattagtcagtgcaaaacagcttggtgtggatagaattgtagattttcaatttggaagtgatgaagctgcttaccatttaatcattgagctctatgatagggggaacattgttcttacagattatgagtacgtaattttaaatattctaaggtttcgaactgatgaggcagatgatgt

SEQ ID NO: 2639 - DNA, 1081 bp, Homo sapiens
caagcgcagacggaaccgcgatggtggcacctttattagtgatgcagacgacgtcgtgagtgccatgatcgtcaagatgaatgaagctgctgaggaagacagacagttgaacaatcaaaaaaagccagcactgaaaaaattaactttactgcctgctgtagttatgcaccttaagaagcaggaccttaaagaaacattcattgacagtggtgtgatgtctgccatcaaagaatggctctcacctctaccagataggagtttgcctgcactcaagatccgggaggagctgctgaagatcctgcaagagctgcctagtgtgagccaggagaccctgaagcatagtgggattggacgagcagtgatgtatctctataaacaccccaaggagtcaaggtctaacaaggacatggcagggaaattaatcaatgagtggtctaggcctatatttggtcttacctcaaactacaaaggaatgacaagagaagaaagggagcagagagatctagaacagatgcctcaacgacgaagaatgaacagcactggtggtcagacacccagaagagacctggaaaaggtgctgacaggagaggagaaggctcttagacctggagatcctggattctgtgcccgtgcaagggtcccaatgccttcaaacaaggactatgttgtcaggcccaaatggaatgtggaaatggagtcatccaggtttcaggcgacctccaagaagggtatcagtcgactggataaacagatgagaaagttcacagatataaggaaaaaaagcagatctgcacacgcagtgaaaatcagcattgagggcaacaaaatgccattgtgaccttgcctggaatgtgtccccatctctactctaagaaatgcgcaatggactctttggagaaagaagatattttaaaacatttttagtgtgtctgtaaatggttcagcgtgtatcagatgttgtcataggactcacatttctctcagttatatttaaaaccgttgtgtactttgtacaaaggaatactagtcatacttctataaactttacacaataaaatttcattctggttaaaaaaaaaaa

SEQ ID NO: 2640 - DNA, 1516 bp, Homo sapiens
aattccgttgctgtcggtcccacccccacctcgccggagtccggggcggccccggtgtcccctccgagcctgctgcactccrcrtcyysmywscarskctyswssycyyakgkrrrtstcygamywgrycygtcycwgsagccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatctgcaggatggactttctggtcctcttcttgttctacctggcttcggtgctgatgggtcttgttcttatctgcgtctgctcgaaaacccatagcttgaaaggcctggcaggggaggagcacagatattttcctgtataattccagaatgtcttcagagagccgtgcatggattgcttcattaccttttccatacgagaaaccacaccttcattgtcctgcacctggtcttgcaagggatggtttatactgagtacacctgggaagtatttggctactgtcaggagctggagttgtccttgcattaccttcttctgccctatctgctgctaggtgtaaacctgttttttttcaccctgacttgtggaaccaatcctggcattataacaaaagcaaatgaattattatttcttcatgtttatgaatttgatgaagtgatgtttccaaagaacgtgaggtgctctacttgtgatttaaggaaaccagctcgatccaagcactgcagtgtgtgtaactggtgtgtgcaccgtttcgaccatcactgtgtttgggtgaacaactgcatcggggcctggaacatcaggtacttcctcatctacgtcttgaccttgacggcctcggctgccaccgtcgccattgtgagcaccacttttctggtccacttggtggtgatgtcagatttataccaggagacttacatcgatgaccttggacacctccatgttatggacacggtctttcttattcagtacctgttcctgacttttccacggattgtcttcatgctgggctttgtcgtggttctgagcttcctcctgggtggctacctgttgtttgtcctgtatctggcggccaccaaccagactactaacgagtggtacagaggtgactgggcctggtgccagcgttgtccccttgtggcctggcctccgtcagcagagccccaagtccaccggaacattcactcccatgggcttcggagcaaccttcaagagatctttctacctgcctttccatgtcatgagaggaagaaacaagaatgacaagtgtatgactgcctttgagctgtagttcccgtttatttacacatgtggatcctcgttttccaagcatggcttgtttgttttgatttctgctgtgcttataaatcactttcggtgggcaagggagagaggggaaaatgggtgttgactgaggaatcccccttgcttgtcttcttttg

SEQ ID NO: 2641 - DNA, 888 bp, Homo sapiens
  misc_feature (1)...(888): n = A,T,C or G
aattccgttgctgtcggcagctggatggacactatagcaaacatcaatcaagagctcattaaatatgaattcttmyyygrmrcmrstcgaagtgaagaagacttaaagaaataccccaagtacccctggggrrgagaaatctatactttagaaggtgttgtggatggagctccatattccatgatttctgacttcccttggctgaggtcattacgagctgcagagcccaacagcttcgctcgatacgactttgaagacgatgaagaaagcactatctatgctcctagaaggaaaggacagctgtctgcagacatctgtatggaaacaataggagaggaaatttcagagatgcgtcagatgaagaagggtgtatttcagcgagtagtggcaatttttatccactattgtgatgtcaatggagagccagttgaagatgactacatttaattggtccctcctcctttccagctattttgtcagaaagcaagtagggccatccagctgccagagtgctccacagggacttgaggcatgcagttgggaggtcctggctcggtttgctatatagggaatatataaggaacatcgaaattgtatacaaagatttgtacataaaaaatatacaaagacgcttcctaaagtaccaactttatatcatatgtttatacaatttaatttaaaaattcattttaaggaagacagataatttgaaagacttttgtttttcttgacttaattcatgaagtatcattttttgactgagtctccatttacttcattcttaatgattattgtcatccctttaaatctgtgcctttttcttcttgagcgaagctgtttgagtaaacctgttgaagagtggtttggnggccnttttggngccttttt

SEQ ID NO: 2642 - DNA, 300 bp, Homo sapiens; identical to SEQ ID NO: 205

SEQ ID NO: 2643 - DNA, 770 bp, Homo sapiens
ctgacttcaactgcaatggtcctgtcaacacacagggattctacaggggctcccctgggtgcgtcatggatgctgttctgcgccacggctgtgaggcagccttcgtgagcctgctggtagaatttggagccaacctgaatctagtgaagtgggaatcgctgggcccagagtcgagaggaagaagaaaagtggaccctgaggccttgcaggtctttaaagaggccagaagtgttcccagaaccttgctgtgtctgtgccgtgtggctgtgagaagagctcttggcaaacaccggcttcatctgattccttcgctgcctctgccagaccccataaagaagtttctactccatgagtagactccaagtgctgcggttgattccagtgagggagaaagtgatctgcagggaggtggacaccgagccctgagtgctgtgctgctgctggtctcctgatggctgttgctgcagaagatgtcctcgtagactgtcattgctcctcaggtgcctgggccgctgaacagtccttgggtcattgtcagctgagaggcttatactaaagttattattgtttttcccaagttctctgttctggattttcagttgcatattaatgtaacgggccatggggtatgtacatgtaggggctgaggttggaggcctactaatttcctgtagggaagactcccagcacttctggaactgtgcttctctttatttttctacttctcaatttgatggttcgattaaagccttctagtatctcaatgaaaa

SEQ ID NO: 2644 - DNA, 603 bp, Homo sapiens
aattccgttgctgtcggtacgatacttaaaaccatcacaagctgcccaagcaatagaaaactgtgatcgaagttttagagcaatcttggctgaacctaaaaataaagcatctgaatcctctgaacaagattattatagtaatatgaggcaagaagctttgggacatgaacctagagtaaatatgtttccatttgaacaacaatctgaattttcaagttttgacaagaatgatagccgaggccaggaagcaatctccaaacgcttgtcagttgtatcaagagttcctttcactgaagaacagcttttcagcatttttgatatagtaccaggattggaatattgtgaagttcaacgagatccttattcaaattatggtcatggagtggttcagtattttaatgtagcatcagctatttatgcaaaatacaaattacatggatttcagtaccctcctgggaaccgaataggtgtttccttcattgatgatggagtaatgcaacagatctccttagaaaattgcacacagatggtagctgcacagcttgcatcaattggttggattacccaagtcagcacattattgcaatttgaggagccttggat

SEQ ID NO: 2645 - DNA, 685 bp, Homo sapiens
  misc_feature (1)...(685): n = A,T,C or G
gtaaggcctgccttttacacaccagttgtgtgtttgttagtggctgctggatgccagtccacaccctcaaacacctcacagtcccaaacggggtgctcctacaggtcccagggtcctgttagtggaagaaaggcagttccaggaagtcttccctctagccttcatgacaggaagtagtttaatcctctgggaaatagacttgcagccctgggaagaaaagagttgttcctccttggggacatacaccatcatctgggctatttcatccagtgtctcttctttatacaggagctcctggctcaggaaggcatcccgtgcacacagcctcacgtgacggtactccaaaggcaggaaggggatgaagtagtcaatcaggttttccttcacaagacggctgtgccaaagccattgtctatggtctccacaatctccgcctggaggtggggctccaggtgttccatcgtaatttcttcccgggaccatccagccttgagcaactttaggaccacctcattgattatatcgcccctgagattactgagaaacagaaagatagtccatggagactcagcccnttgtnctcaggggcccggcgttctaagtgtggcccaaggacctccagcagccctgggtgcagcttctccgcttcatcgaagatgaacagggtctggtgcagagctgctgc

SEQ ID NO: 2646 - DNA, 583 bp, Homo sapiens
agtggctgagtggaggcgcccagacctgggcaggcagcaggctcaggcccacaccttgtgatttttgaaaccaaagcccagaagatgatgtttacttctctctccctggctctgcccttcttactgcaaaccatgctgtgccttagggcccttctcatagctgttcctcatggccatgactggaacagggatgcaacctctttctacacaagcacagttagttgggtgaagtctttttttttgtttgttttagacggagttwcactcttgttgcccaggctggagtgaagtggcgtgaccttggctcactgcaacctccaggccagcctcagcctccctagtagctgggactacaggcacccactaccacgcctggctaattctttgtatttttagtagagatggggtttgaccgtgttagccaggatggtctcgatctcctgacctcgtgatccacccacctcggcctcccaaagtgctgggattataggtgtgagccaccgcgccgggccggttgctggcatcttaatgttctgtaggtggaatatttccaataaacacaaggtgccgtaattgacaaaaa

SEQ ID NO: 2647 - DNA, 958 bp, Homo sapiens
  misc_feature (1)...(958): n = A,T,C or G
atcgagaactcttactacaagctncttgttctttttgcaggatcccatngattcgwrkyssgttgctktcgccaaaatggcgcgggtgctgaaggctgcagccgcgaatgccgtagggcttttttccagacttcaagctcccattccaacagtaagagcttcttccacatcacagcccttggatcaagtgacaggttctgtgtggaacctgggtckactcaaccatgtakccatagcagtgccaratttggaawakgctgywgcawtttataasaatattctgggggcccaggtaagtgaagcggtccctcttcctgaacatggagtatctgttgtttttgtcaacctgggaaataccaagatggaactgcttcatccattgggacgtgacagtccaattgcaggttttctgcagaaaaacaaggctggaggaatgcatcacatctgcatcgaggtggataatattaatgcagctgtgatggatttgaaaaaaaagaagatccgcagtctaagtgaagaggtcaaaataggagcacatggaaaaccagtgatttttctccatcctaaagactgtggtggagtccttgtggaactggagcaagcttgatttatatttgcaagcaactaaattaattgacctgaaaaagcctatcaaatactatcaaaatgtactatgacattgagtccttcactgcttccatcatgtaaaagttcacagttaaagactgaattacagaaagattaaaatatatacatatataaatacataaatatgtatattatttagattaacaaacatatttgttaatttgaatttgaagaaaatcttgattactaattacttagggaacattattaaaatcatatagaaataaattattcctcttctacaatggggkgnaattgaatgtnatggtgtttagcngtggacnaggggnatgtgtgtgatggatgggta

SEQ ID NO: 2648 - DNA, 1583 bp, Homo sapiens
  misc_feature (1)...(1583): n = A,T,C or G
ggagaagcaactgacgacagatgctgcccgcattgtgcagatgcagcccagaagcagatccagagcttgaataaaatgtgttcaaaccttctggagaaaatcagcaaagaggagcgagaatcagagagtggaggtctccggccgaacaagcagacctttaaccctacagacactaatgccttggtggcagctgttgcctttgggaaaggactatctaattggagaccttcaggcagcagtggtcctggccaggcaggcmrsccaggagctgggacgatccttgcaggaacctcaggattacagcagstgcagatggcaggagctmcaagccagcagcagccaatgctcagtggggtacaaatggctcaggcaggtcaaccagggaaaatgccaagtggaataaaaaccaacatcaagtcggcttccatgcatccctaccagcggtgagtgtggctggcaacctcgactccctggtgctctttgcagagttgggcagtgaaattaccttttgctcaaggctcacctagatgggtacaataaaaagaacatgggctttcagcagcagacaaatcccacttccaccactgactagctgtgtgaccttggacaagtgacctaatttttctgagcctgtttctcatttgtaaatggtgataatacctacctcatagggttgttgtgaggattaaaatgaggaaatgaatgtaaagcacttagtacagtatatgaaataatgggtattcaataaatgatagtttctacagatccttctccccaccaccctccacagtccttgatccagaacttaccctaatctgatactgcctcacgtcaatggtgagctgatggacacaagatcaaataaggctatgcttattttgtgctgccagaaactgtagcaacctctgtgttcttagaggcacactgtttttgcaggccctcctgcctggggtttcattctggctatccctctaaggcgcaaggtgaagaagcttctgggccaggaaggaaaaaaaaatgcccacctgcagctctggtgaagcttgggcctgctctcctttccatcctctaaggagccaacttggcttttacctgtcaaatagtcataaagtcccctatcctttaccccaccttatacacacgaggctttctcaggnaagtggctctgccaggcaggactatgtgggaaagggtttttccttagcacacgaaaaagccccttcccctggattcatgtttcttattttggagggagaagggaattgcacttcacactgccatcagggtttagttgacctcataatggtgcccactttctcgactttggccaggatttccttcaaagaaaacgactttccttcatttccctaagcctgtggcccaaatggtggaccagaatgatggtgggagggggcaacccccagtagctttgcctgcttttataaagttgaacaaattgaatttagacattcaggctaacctgcctttcttagtactcctttgttggcatgggcaggggttgagtcagcagaagtggaccaaaggattcctctgaataaagttatttaaattgaaaaaaaaaa

SEQ ID NO: 2649 - DNA, 1518 bp, Homo sapiens
  misc_feature (1)...(1518): n = A,T,C or G
gaaacatggggaaaagttcgtaaactcctggttgatgcaattcataatcaactaactgacatggaaaaatgtattttgaaatatatgaaaggaacatctattgtggtccctgaaccactgcactttttattaccagggaaaaaaaatcttgtaacaatttcatatccttcaggaataccagatggccagctgcaggcctataggaaggagttacatgatcttttcaatctgcctcacgacagaccctatttcaaaaggtctaatgcttatcactttccagatgagccatacaaagatggttacattagaaatccacatacttaccttaatccacctaacatggagactggtatgatttatgtggtccagggcatatatggctatcatcattatatgcaggatcgcatagatgacaatggctggggctgtgcttatcgatctctgcagactatctgctcttggttcaaacatcagggatacacagagaggtccattccaacacacagagaaattcagcaggctctagtcgatgccggggacaaaccagcaacatttgtcggatcgcggcaatggattggatctattgaggtgcagctggtactaaaccaattgatcggtataacgtcaaaaatcctgtttgtcagccaaggttcagaaattgcctctcaaggacgggaactggctaatcatttccaaagtgaaggaactccagttatgatcgggggaggagttttggcccacacaatactaggagttgcatggaatgagattacagggcagataaagtttctgattctagatccacattataccggtgctgaagacctgcaagttattttggaaaagggctggtgcggatggaagggcccagatttttggaacaaggatgcatactataacttatgtcttcctcagcgaccaaatatgatttaaaatatcttggagtcaaagactgcagtagagtggtattataaatttgtgaataaagaatcagtttaatttttcacattaaatcctggttctagtttgaccatttaaattatgacctttttcaaaggttgtaaatactgcacggagaatgtattttttagacgttcctttaataacttaaaagacaaagcatacacaaccagcatattataggcatgtaaatacatgtgttcttaaatggatcttcacttggaagaaagtttttcgtccttctcagaaggagattagacacaacatatggtaaagccaaaagcaggagcttatagatttgcatgaaatgaaggcgttcttcagacttcttcataacccacgtgacatcagcacttccttttcccactggtattttctacacttccgagactccgtttctgtctgagcacggcaacacaatcattcctgtcagggtgttcacttgctttttatttggcctgcattacattntaaattggttggtaaagaaaacttggggcacaagtcctngggaaattccaccatggaccaaagcggagattcttcnaggctggtttg

SEQ ID NO: 2650 - DNA, 386 bp, Homo sapiens
  misc_feature (1)...(386): n = A,T,C or G
gggaagtttgtcaatgacaagagcaggaagagcgagaaggtgaaggtgattgacgtgactgtgcccctgcagtgcctggtgaaggactcgaagctcatcctcacggaggcctccaaggctgggctgcctggcttttatgacccgtgtgtgggggaagagaagaacctgaaagtgctctatcagttccggggcgtcctgcatcaggtgatggtgctggacagtgaggccctccggataccaaagcagtcccacaggatcgatacagatggataaactgccaagaaccagatttttaaaaggccgcaaaaaatcttttcctgggagtctacaaatttggaaatgaaaaaacccngacatcagatgtttttattttatattattattat

SEQ ID NO: 2651 - DNA, 485 bp, Homo sapiens
  misc_feature (1)...(485): n = A,T,C or G
ctcagctctcaccagctgtcagatgctgccacagggcgagaacctccaagatgtgctccccagggacatctactgccgcctcaagcgccacctggagtatgtcaagctcatgatgcccttgtggatgaccccagaccagcgcggcaaggggctctacgcagrcwmsmkcttcaatgctattgccggaaactgggagcgcaagaggcctgtctgggtgatgctcatggtcaactccctgactgaagtggacattaagtcccgtggagtgcctgtyttagacctgttccttgcccaggaggctgagcggctgaggaaacagactggggcagtggaaaaggtggaagagcagtgccatccattgaatgggttgaacttttcacaggtcatctttgctttgaaccagaccctcctgcagcaggaaagnctgcnagcaggcagtcttcagatcccctacacgacggaggatctcatcaaacactataact

SEQ ID NO: 2652 - DNA, 766 bp, Homo sapiens
  misc_feature (1)...(766): n = A,T,C or G
aattccgttgctgtcggaaaatattattatgttagttttagcgtggaaattggaggctgaaagcatgggattttttaccaaggrmrmrwggttaaagggaatgacttcattacagtgtgactgcacagaaaakttacaaaacaaatttgactttttgcgctcacagttgaatgatatttcgtcatttaagaatatctacagatatgcctttgattttgcaagggataaagatcagagaagccttgatattgatactgctaaatctatgttagctcttctgcttgggaggacatggccactgttttcagtattttaccagtacctggrgcaatcaaagtatcgtgttatgaacaaagatcaatggtacaatgtattagaattcagcagaacagtccatgctgatcttagtaactatgatgaagatggtgcttggcctgttcttcttgatgaatttgttgagtggcaaaaagtccgtcagacatcatagcaagaactatgtgaagaaaatgcaaacctttcaattcccacgtgtatacaagctaatgtgatgagggggaaaaaaatccaacgggtgcattttcattcatatgaaagacttctcatagtacttttttttcctttttttaaaggaggtttttcttgttacatgtgatgggcattgagccacacctcttcttagactgaatattgaagtttttgttttgagttatgtttataacatttatttcagamcantaawgrttncaggattkgtgacaaaggcaaa

SEQ ID NO: 2653 - DNA, 401 bp, Homo sapiens
gtttgagctcttgagccagtgacttccctgcacgttcagctttctcctttgtgaaatggtaatagaagcacgctgcacttgggattcttgtggattacatgtgagggtcttagaaacacttgatgtgtaagccaactattatgtattactgtatatggaacacaagggatgtagccaaaactaaatgcaagtttgtgcctcagatgtcttcctatcagaacagagtcaaatccagattttgatgctkwratgtgacagcttattcagatttagaaaaacttttggtatgggccaaagaaaacatatccttaaggggatatgcccctaggccctcattttccttttctgtctgagcaattaaaaaaaggaaaatgaggcctaggggccatatccccgtcgta

SEQ ID NO: 2654 - DNA, 475 bp, Homo sapiens
  misc_feature (1)...(475): n = A,T,C or G
aattccgttgctgtcggccggaaccacgaggagagcagtgagaccatgaatgacttgctggcccaggtggccactaacacggacaccagccgaaatgccggaaatgcggtcctgtttgagacagtactcaccatcatggatatccgctctgcagctggcctacgggttctagctgtcaacattcttggtcgcttcctactcaacagtgacaggaacattaggtatgtagccctgacatcactgcttcgactggtgcagtctgatcacagtgctgtgcagcggcatcggcccactgtggtggaatgtctacgggaaactgatgcctccctcagccggtgagcagtgatagaggggacaggagggcagggcagaggttcccagtgccctgtggccaagactcgagccagtttagagcagctggagtaaggggactaagggggacaggtccctgggggaagcagagggcctnaggcat

SEQ ID NO: 2655 - DNA, 1731 bp, Homo sapiens
  misc_feature (1)...(1731): n = A,T,C or G
gacatttcsrmwmgmkcytttgtgaatttccagatatgggattttcctgggcaaatggactttttkgacccaacctttgactatgagatgatcttcaggggaacaggagcattgatatacgtcattgacgcacaggatgactacatggaggctttaacaagacttcacattactgtttctaaagcctacaaagttaacccagacatgaattttgaggtttttattcacaaagttgatggtctgtctgatgatcacaaaatagaaacacagagggacattcatcaaagggccaatgatgaccttgcagatgctgggctagaaaaactccatcttagcttttatctgactagtatctatgaccattcaatatttgaagcctttagtaaggtggtgcagaaactcattccacaactgccgaccttggaaaacctattaaatatctttatatcaaattcaggtattgaaaaagcttttctctttgatgttgtcagcaaaatctacattgcaacagacagttcccctgtggatatgcaatcttatgaactttgctgtgacatgatccgatgttgtaattgatgtgtcttgtatatatgggttaaaggaagatggaagtggaagtgcytatgacaaagaatctatggcaattatcaagctgaataatacaactgtcctttatttaaaggaggtgactaaatttttggcactggtctgcattctaagggaagaaagctttgaaagaaaaggtttaatagactacaacttccactgtttccgaaaagctattcatgaggtttttgaggtgggtgtgacttctcacaggagctgtggtcaccagactagtgcctccagtctgaaagcgctgacacacaatggcacgccacgaaacgccatctagtctgaatcccagcgtcggggctctgtgccagcttactcttcactccagggtcggatgccacgtgctacaggacatgggagctgctgcttgtgggaatctggtgcctgttccactagagacaaggggtagagtttctcatttggatgaaaaccccttcaactggtggtgtacaactgaagctactatatcttttttgaaaatggcaaaaaaaaaaaaaaaaaaattctggagaccacagaactcaagtgtgtgtttctcctcttttgggtcccctttaagtagttgggatattttggacctggagataacaccagttacccatccttaccagggaatgttgccatcaattccagttgaaaataatagaaaagactgaatttttatatgcttcacttaggctttcatttgagtagactctaaaaattctgccttgcttaagttctaacactgcctctcagatttcagttttggacattgcacaactaagaccttttaaacgcatttgcttgctaactcggaagacacatagtctgcagcaagacattcctatattgaagaaatgagagaaaattttatgctgcatcaggtggagagcaaggctcaacggtggttgcattagttccctcggaagtattgaaaaaactttgaaatggaagaaaatttttggcacctatgttctgagtaccagatgtctggggttctttcttctgcattaggataaatgnatcatgctcagtgntaacaaaggggaattaaaagtttttcccacagtccccttctaggggaggaaaanccattggtggccactggaatggttagcttactttaatcttggn

SEQ ID NO: 2656 - DNA, 300 bp, Homo sapiens; identical to SEQ ID NO: 1011

SEQ ID NO: 2657 - DNA, 300 bp, Homo sapiens; identical to SEQ ID NO: 1541

SEQ ID NO: 2658 - DNA, 300 bp, Homo sapiens; identical to SEQ ID NO: 1547

SEQ ID NO: 2659 - DNA, 300 bp, Homo sapiens; identical to SEQ ID NO: 1025

SEQ ID NO: 2660 - DNA, 908 bp, Homo sapiens
  misc_feature (1)...(908): n = A,T,C or G
aattccgttgctgtcgggtagaaatgggtccatttaaacatacggttgatgatggtctggatattagaaaggcagcatttgagtgtatgtacacacttctagacagttgtcttgatagacttgatatctttgaatttctaaatcatgttgaagatggtttgaaggaccattatgatattaagatgctgacatttttaatgttggtgagactgtctaccctttgtccaagtgcagtactgcagaggttggaccgacttgttgagccattacgtgcaacatgtacaactaaggtaaaggcaaactcagtaaagcaggagtttgaaaaacaagatgaattaaagcgatctgccatgagagcagtagcagcactactaaccattccagaagcagagaagagtccactgatgagtgaattccagtcacagatcagttctaaccctgagctggcggctatctttgaaagtatccagaaagattcatcatctactaacttggaatcaatggacactagttagatgtttgttcaccatggggaccattacatatgaccatacaatgcactgaattgacaggttaatcataagacatggaaagagaagtgtctaaaagcttcaaaatgttccacttttttttccttcatggagactgtttgtttggctttcttccattgttgtttttgtagcatttatttcagaaatgtgtatttccataatccagaggttgtaaaaccactagtgttttagtggttacagcaacatttgaaatggaaactaaaagttaggattttatggagtatggagatagggtccagtatctatttaccctgtaatgtttaggattaaaatgttaaaattttgtgaccntgaatttctttcttttataaattttctcatttaaaaatcaaaaaa

SEQ ID NO: 2661 - DNA, 872 bp, Homo sapiens
aattccgttgctgtcgaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacmagggaatactattraaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctcgtgattccacctatgatgtttgatgcagaacaaagacgagtcaagtycattamcatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtkttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacaraaaaaaaagaagaagaaaagaaagatgaagagga

SEQ ID NO: 2662 - DNA, 448 bp, Homo sapiens
cgcgctttgaaaaaatgagatcagcaaaacgcaggcaacagacctaatacatttcaaaacttgatatttcattttgcgttttagctagagaagttttccttgtgacttactaatggctgcaatgccaatgattgtaagaaaacaaacaaatttatcatgaaattctccttgtcattttatamrtssmyattttaacatcatttatggttccagagatgcatacacttttttctgacaagaaaaagtaaaaggtgatgagggcaattctgtcctactgtttttacaggcctttttcaaatgcagattttgtcataaagttgttatagattttttaaaatgcttttttaatattaaaatgtacttttacattcttaatctttttttagaaaggaaaagttttcttcatttagctgctgatttaaaagtaaagttctccaattcttaaaaa

SEQ ID NO: 2663 - DNA, 498 bp, Homo sapiens
  misc_feature (1)...(498): n = A,T,C or G
aattactagtgggggagtaaggggacaggccattgggcatactggagcagcatttactcagtcattgagaaaaggatggaacattcaataaagggtgctggacacatttgtgctctaaaaattttgtgtttcacctattaatttatccctccccttagcccctggcaaacactgatctgtttactgtctccatagttttgcctttcccagaatgtcacacccttggaatcatacagcatgtaaccttttcagattggcttcttttacgtagtaatatgcatttaggattccttcatgccttttcctggattgatagctcatttntttttagtcctgaataatattccattctatggatataccacaattgatccattcacctactgaaggtcattttgattgcttccaagttttgataatttaaaaaattttttaagacagggtgtcattgtgttttccatactggtctcctgaacacctgggctgatgtgaacccct

SEQ ID NO: 2664 - DNA, 300 bp, Homo sapiens; identical to SEQ ID NO: 1065
  misc_feature (1)...(300): n = A,T,C or G

SEQ ID NO: 2665 - DNA, 787 bp, Homo sapiens
  misc_feature (1)...(787): n = A,T,C or G
gccacgtttgcaaaaatgcagcaaaaaagttacttagtctggctgtttagtagaatttacctctactcattcatcagcctctttatatatatgattttaagtcttttcattgcactgatcactgatacatacgaaacaattaagcaataccaacaagatggcttcccagagactgaacttcgtacatttatatcagaatgcaaagatctacccaactctggaaaatacagattagaagatgaccctccagtatctttattctgctgttgtaaaaagtagctatcaggtttatctgtactttagaggaaaatataatgtgtagctgagttggaacactgtggatattctgagatcagatgtagtatgtttgaagactgttattttgagctaattgagacctataattcaccaataactgtttatatttttaaaagcmatatttaatgtctttgcaactttatgctgggattgtttttaaaaaaactttaatgaggaaagctattggattattattatttcttgtttattttgccatggctttagaatgtattctgtatgcctctcttttgctctgatactgttgctcctgctattctgattgtgcagactgtataattagtggaaaacaatccttggtctgactgtgactttggacactcagtnaccctggcttggaccactctcaggagncatncttgagagagtgggtgtagttacatttntcagtaacatgnatttaaantcccttganaggaagaatagagtnacagaatagacncacagaatn

SEQ ID NO: 2666 - DNA, 703 bp, Homo sapiens
ttgtgaaccagatgatgaaagtggctatgatgttttagccaaccccccaggaccagaagaccaggatgatgatgacgatgcctatagcgatgtgtttgaatttgaattttcagagacccccctcttaccgtgttataacatccaagtatctgtggctcaggggccacgaaactggctactgctttcggatgtccttaagaaattgaaaatrtctctcccgcatatttcgctgcaattttccaaacgtggaaattgtcaccattgcagaggcagaattttatcggcaggtttctgcaagtctcttgttctcttgctccaaagacctggaagccttcaaccctgaaagtaaggagctgttagatctggtggaattcacgaacgaaattcagactctgctgggctcctctgtagagtggctcaccccagtgatctggcctcagacaactactggtgagcaagctggacccascmtgtacagtgtgttatagtgttaatccttgtgcatatgtgtcataatacaactatttctgtaaagaaaggacactattacatatgaaaatatctcttctttatataagagaaattactccagtcagaaggacttagaaacatgtttttttccttttaaacttttaagtcagtttttatgaagttgttataatgtttctttacttttcaatgcacacatgctttgggatacgtt

SEQ ID NO: 2667 - DNA, 1018 bp, Homo sapiens
  misc_feature (1)...(1018): n = A,T,C or G
aattccgttgctgtcggaaactccctggagcgacgcagcgtccggatgaagcggccttcctcggtcaagtcgctgcgctccgagcgtctgatccgtacctcgctggacctggagttagascwssaggcgacaagaacctggcacagccaattgacccaggagatctcggtgctgaaggagctcaaggagcagctggaacaagccaagagccacggggagaaggagctgccacagtggttgcgtgaggacgagcgtttccgcctgctgctgaggatgctggagaagcggcagatggaccgagcggacacaagggtgagcttcagacagacaagatgatgagggcagctgccaaggatgtgcacaggctccgaggccagagctgtaaggaacccccagaagttcagtctttcagggagaagatggcatttttcacccggcctcggatgaatatcccagctctctctgcagatgacgtctaatcgccagaaaagtatttcctttkttccaytgaccaggctgtgaacattgactgtggctaaagttatttatgtggtgttatatgaaggtactgagtcacaagtcctctagtgctcttgttggtttgaagatgaaccgactttttagtttgggtcctactgttgttattaaaaacagaacaaaaacaaaacacacacacacacaaaaacagaaacaaaaaaaaccagcattaaaataataagattgtatagtttgtatatttaggagtgtatttttgggaaagaaaatttaaatgaactaaagcagtattgagttgctgctcttcttaaaatcgtttagattttyytsgttgtacagctccaccttttagaggtcttactgcaataagaagtaatgcctgggggacggtaatcctaataggacgtcccgcacttgtcacagtacagctaatttttcctagttaacaatttgtcatattammmmntgcacagammaccattgggggggattcagaggtgcatccacggntcttcttgagctg

SEQ ID NO: 2668 - DNA, 587 bp, Homo sapiens
atcatattcaagttggcaggtttgactgttcctctgcaccagacatctgtagtaatctgtatgtttttcagccgtctctagcagtatttaaaggacaaggaaccaaagaatatgaaattcatcatggaaagaagattctatatgatatacttgcctttgccaaagaaartkygrmwkmksatgttaccacgcttggacctcaaaattttcctgccaatgacaaagaaccatggcttgttgatttctttgccccctggtgtccaccatgtcgagctttactaccagagttacgaagagcatcaaatcttctttatggtcagcttaagtttggtacactagattgtacagttcatgagggactctgtaacatgtataacattcaggcttatccaacaacagtggtattcaaccagtccaacattcatgagtatgaaggacatcactctgctgaacaaatcttggagttcatagaggatcttatgaatccttcagtggtctcccttacacccaccaccttcaacgaactagttacacaaagaaaacacaacgaagtctggatggttgatttctattctccgtggtgtcat

SEQ ID NO: 2669 - DNA, 300 bp, Homo sapiens; identical to SEQ ID NO: 354

SEQ ID NO: 2670 - DNA, 1187 bp, Homo sapiens
gggagacctatacctagatgttgctgaagcttttctggatgttggtgaatataattctgcacttcccctcctcagtgctcttgtttgctctgaaagatacaaccttgcagtagtttggcttcgtcatgcagaatgtttaaaggccttaggctatatggagcgagctgctgaaagctatggcaaggtggttgatctggccccactccatttggatgcaaggatttcactttctacccttcagcagcagctgggccagcctgagaaagctctggaagctctggaaccaatgtatgatccagatactttagcacaggatgcaaatgctgcacagcrggaactgaagttattgcttcatcgttctactctgttgttttcacaagggcaaaatgtatgggttatgtgggataccttacttactatgttaggccatgcttttaaaggtagcaatgaatcgagcccaagtttgtttgatatccagttccargtctggagagaggcatctttatcttattaaagtatcgagagacaaaatatcagacagcaatgaccaagagtcagcaaattgtgatgcaaaagcaatatttgctgtgctcacaagcgtcttgacaaaggatgactggtggaatcttctgttgaaggccatatactccttatgtgacctatcccgatttcaagaggctgagttgcttgtagattcctcattggaatatkactcattttatgatgacaggcaaaaacgcaaagaactagaatactttggtctgtctgctgcaattctggacaaaaatttcagaaaggcatacaactatatcaggataatggtaatggaaaatgtcaataaaccccagctctggaacattttcaatcaagttaccatgcactcccaagatgtacgacatcatcgcttctgtctccgtttgatgctgaaaaacccagaaaatcatgccctatgtgtcttaaatggacacaatgcatttgtatctggtagttttaagcatgcgcttggacagtatgtgcaagcctttcgcactcaccctgacgaacctctctatagcttctgtataggcctaacctttattcatatggcatctcagaagtatgtgttacggagacaagctcttaatgtacagggctttccctttctaatcggtacctcaattacgtggggcctgcaggaatccatctac

SEQ ID NO: 2671 - DNA, 1402 bp, Homo sapiens
  misc_feature (1)...(1402): n = A,T,C or G
aattccgttgctgtcggccactgcgcacggcctggggaggttttatttcttgacaaaggtatttgatactcgtgcagtccctggagggtctcactggagagacaacatttaggctgagatctgattaacaggaggcagctgcagtgcagaggtcaaaagggagggtgttccaggcagagaaaacagcctgtgcaaaggccctgaggmagaaacaaactctacttgaggtcagcctggttagaaagcccaactcaaaatagaaagtattacatgataaggtctgaggcaggctggacccagatcttacaggaccttgttaataaggatcccatttggtcccccacagtcctgagaagcgggcagggctgtgggaaacagcagatatttagtggtaagcctgagatcagaacccaagtctgcacttcctagtnacgttctccctgtagtgctaagcccagagacctgagctgttaacctagaacagtgtgcttcctaagccttaatgtgcatacccatcgcctggagctcgccttaagatgtaggttctgcctgaagcccaagttcatttagtatgtcatggttaattcagagtaaaatcaagagttagtacttgatttatgcttgttatataaagaaagagacaacttcactgtatgatcattttgtcacttttcaaaagcatttaattcccattcaattgaaaatgtttcaagaacaaacctgtttggtcattttattgatattgcacatttgtatatgaataaatttttgcaaattaarraaraaaagatgtaggttctgaaacagggtgaggtccaggatcctgcctttctaaggagctcccacgttgtgcagttgctgctggcccggggaccacattgaatgacggctctacgtcctcatgcctccagctgctgccctgtacatgtccaactgcacggagcactttacatcctctaaaaccacagtaaattgctccatttcctaaattacctcttcaagagaagactggttttgatgtcatttttaaataaaggagaagttgaatttcaaaaccaagtggaacaggaatgatgtgacttggttgacattgattttaacatttggttcatggtgagtgttttgctttattgttaaaaactcgccactaaaagcatgacagaacattttatcaaatgatggcgtcatcctttaccgtaagtttgcccctagcaagacagctcttcctgagacgtgcttgcaggcccctatgtgggttttcccaccgcagtcatcatccgtcatctgtgaccttgctgcatttactccatgctcacaccccagcagcccgcnggggtttgggcatcgcccttcagngggcatcaaacttccccnggtggcaatgttacaagagttaggccag

SEQ ID NO: 2672 - DNA, 343 bp, Homo sapiens
  misc_feature (1)...(343): n = A,T,C or G
tttagatgaagtgctgagaatatttagaaaaagcgctttaaaaagcatctagagattatcatgaaaataattggagmmaaagtcactaggctgctttgtgagaggcagcataccatggctctaaacccgttcacaaaaaacaatgttagagacattaggaattcaggttttgaaaatctttttttcgatttatttgtaatttacataccaaaaaaccacattaaaatagtcctcccttcaacatggctatcttttttcaagttttatatgcatagctctctcagcacttgaatggaaaamtgtacagcattgggagnagttnttctttgagacantgggcagt

SEQ ID NO: 2673 - DNA, 509 bp, Homo sapiens
gccctgtttgcctataagatgtcatcggtgcagatgatgtttggggtcaatttcttctcctgcctcttcacagtgggctcactgctagaacagggggccctactggagggaacccgcttcatggggcgacacagtgagtttgctgcccatgccctgctactctccatctgctccgcatgtggccagctcttcatcttttacaccattgggcagtttggggctgccgtcttcaccatcatcatgaccctccgccaggcctttgccatccttctttcctgccttctctatggccacactgtcactgtggtgggagggctgggggtggctgtggtctttgctgccctcctgctcagagtctacgcgcggggccgtctaaagcaacggggaaagaaggctgtgcctgttgagtctcctgtgcagaaggtttgagggtggaaagggcctgaggggtgaagtgtcctactaaaaagaataaatgttggcagtgaattaaacaatttttcaaatga

SEQ ID NO: 2674 - DNA, 485 bp, Homo sapiens
aattccgttgctgtcgggcagtggtttcttagatgttgacaccaaaagcacacgtggcaaaagaaaaagcaaagtcaacaccatcaaagatgaaagtgttcgtgcttcagggaacactatcaagaaagtgaaaagacaacccaagaatgggatagtattttsyamwwcwmmtawmtkytrmgrmkctygayatctattctagctataggactcttacaacttaataaaagagaaaacccacctgggtgcactggctcacgcctgtaatcccagcactttgggaggccaggcggacggatcacttaagcccaggagttcaagaccagcttgggcaacacggcaaaaccctgtctctacaaaaaataccaaaataattagtcgggtatggtggcgggcacctgtggtcccagctaatcgagaggcagaggtgggaggatctcttgggcccaggaggtggaggctgcagtgagccaaaatcagaccat

SEQ ID NO: 2675 - DNA, 1260 bp, Homo sapiens
aattccgttgctgtcggcaactgtgacctggagcgctttgctcaggtcttggagaaggaactgcccctgtatgcgcgccccatcttcctgcgcctcctgcctgagctgcacaaaacaggaacctacaagttccagaagacagagctacggaaggagggctttgacccggctattgtgaaagacccgctgttctatctagatgcccagaagggccgcatacgtcccgctggaccaagaggcctacagccgcatccaggcaggcgaggagaagctgtgattccccccatccctctgagggccggcggatgctggatccggagccccaggttccgccccagagcgtcctggacaaggccagaccaaagcaagcagggcctggcacctccatcctgaggtgctgcccctccatccaaaactgccaagtgactcattgccttcccaacccttccagaggctttctgtgaaagtctcatgtccaagttccgtcttctgggctgggcaggcctctggttcccaggstgagactgacgggttttctcaggatgatgtcttgggtgagggtagggagaggacaaggggtcaccgagcccttcccagagagcagggagcttataaatggaaccagagcagaagtccccagactcaggaagtcaacagagtgggcagggacagtggtagcatccatctggtggccaaagagaatcgtagccccagagctgcccaagttcactgggctccacccccacctccaggaggggaggagaggacctgacatctgtaggtggcccctgatgccccatctacagcaggaggtcaggaccacsccctggcctctccccactcccccatcctcctccctgggtggctgcctgattatccctcaggcagggcctctcagtccttgtgggtctgtgtcacctccatctcagtcttggcctggctatgaggggaggaggaatgggagagggggctcaggggccaataaactctgccttgagtcctcctagcctgtgtgcaaaccacccaagcccaccctgaccccagarccccacagccccactgtggccgcttgatcccccacgccaaccccctggcccattgacccgcctcatctgttcattcacttatctaagctgagggtgtagcaggtaagatgccgcagcccctgcctccaatgtgctggttcagccggggcagtgcccatgtgaatctggcaaggtgtttaacagtgtgggcttgaaagyccaaaccaaaaaaaaa

SEQ ID NO: 2676 - DNA, 649 bp, Homo sapiens
  misc_feature (1)...(649): n = A,T,C or G
aattccgttgctgtcggttgaagcctgggcaggtggtgtacaagtgccccaaatgctgcagcatcaagcccgaccgagcccaccactgcagtgtttgtaagcggtgcattcggaagatggaccaccactgtccctgggtcaacaactgtgtaggcgagaacaaccagaagtacttcgtcctgtttacaatgtacatagctctcatttccttgcacgccctcatcatggtgggattccacttcctgcattgctttgaagaagattggacaaagtgcagctccttctctccacccaccacagtgattctccttatcctgctgtgctttgagggcctgctcttcctcattttcacatcagtgatgtttgggacccaggtgcactccatctgcacagatgagacgggaatagaacaattgaaaaaggaagagagaagatggggctaaaaaaacaaaatgggatgaacatgaaagccgtttttkggccaccccttcttytctagggcttggggccagcccctttttgccacggscaggaccaagggggargggmagaccccttaccagtatgttgggggttttaagggggcccccgacccggcatttgggccactttaggncacaagttnccccaancacaagcactttaccgt

SEQ ID NO: 2677 - DNA, 862 bp, Homo sapiens
aattccgttgctgtcgaaaccawgratctwcwgkyrgmawkwaayaaaaagsaatckgctatctcagtcaswwcatgtattcagyayttkcttctmtctggaytammttraagttactssssktymccaagcagtgaaacgaatggaccaaaggggtaaatctctttgaacaagaaattattctggtgcctattcatcggaaggtacattggagcctggtggtgattgacctaagaaaaaagtgtcttaaatatctggattctatgggacaaaagggccacaggatctgtgagattctccttcagtatttacaggatgaaagtaagaccaaaagaaatagtgatctgaatcttttagagtggacccatcacagcatgaaaccacacgagattcctcaacagctgaatgggagtgattgtggaatgtttacttgtaaatatgcagattatatttctagggacaaacctatcacatttactcagcaccagatgcctctcttccggaagaagatggtgtgggaaatccttcatcagcagttgctgtgagaaaactttgcctggtccctctagctgctggtggttctttcacagacatttccatatacctcatgcattgtgggttaaaaagtccctgcatcacttctgttctcacaggtactgagctgtcaaaagtgcatgaaggcctctcactgtactctagtcctgacttggggtgcagagggctgcttgcaatcctgtttgtaaggctgtgcctgctcagagctttggrctgttcaacccacacaagaacaaacgctaactaatattttttttaagagattcttttccctatgaatgtgggaaatgcaggatttattctgtga

SEQ ID NO: 2678 - DNA, 655 bp, Homo sapiens
ccattgttagcatcgtacacgattgtgatttttatgtcaaaagaagccaaaacttgcaatactatttttagcagacaaaaaaaagaactaagtataaaatgtataaatatttttgacttgaacatttggatggcactgggtsmamgtagagcatccatccttcggatgraatgtttggaaaaaagagacttttaaaaaggagacggttgttttaaagagtctgtttaggggttaaagtactgtaactcacgactgttaaaaaataaattttcctgtgctgtaaaggaaggtttcacagtaccactgagttagatttcagccacagatgcttagctttttttttttgtcttttttttaaggaggaagcctttgttttgttttcctgagccctcactctgtttttgtgctgttactcggtagagtcaagactgttactttttagccatggctgacattgtatcaataactaaaactgaaacattcaaaagcgaacagggaaaccgagggcttcaagcgtgctcagagccgtttcagacagtggaaatccatgacaaacaaaaggatgtgatcattaattgtaaagcgctttgtaaaattcacatttacaaaataataaagtcagttcaaacctaaaaaaaaaaaaaaaaaaaaaaaa

SEQ ID NO: 2679 - DNA, 844 bp, Homo sapiens
  misc_feature (1)...(844): n = A,T,C or G
gtagagaacaacctgctgcatctggaagacttatgtgggcagtgtgaattagaaagatgcaaacatatgcagtcccagcaactggagaattacaagaaaaataagaggaaggaacttgaaaccttcaaagctgaactagatgcagagcacgcccagaaggtcctggaaatggagcacacccagcaaatgaagctgaaggagcggcagaagttttttgaggaagccttccascaggacmtggascwgtacctgtycactggstactctgmagattgcagwgyggygagmycmtwagncagcatgtcatccatggaagtgaacgtggacatgctggagcagatggacctgatggacatatcggaccaggaggccctggacggtcttcctgaactctggaggagaagagaacactgtgctgtcccccgccttagggcctgaatccagtacctgtcagaatgagattaccctccaggttccaaatccctcagaattaagagccaagccaccttcttcttcctccacctgcaccgactcggccacccgggacatcagtgagggtgggagtcccccgttgttcagtccgatgaggaggaagttcaggtggacactgccctggccacatcacacactgacagagaggccactccggatggtggtgaggacagcgactcttaaattgggacatgggcgttgtctggccacactggaatccagttttggctgtatgcggaattccacctggaaagccaggttgttttatagaggttcttgatttttacataattgccaataatgtgtgagaaacttaaagaacagctaacaataaagtgtgaggacggtaaaa

SEQ ID NO: 2680 - DNA, 415 bp, Homo sapiens
aattccgttgctgtcgctggtgatgagatcgggaaagtgggctcaggaggtctggatctgtgatgagatggggaaagtgggctcaagaggtctggatctgtggtgagatgggggaagtgggctcaggaggtctggatctgtgatgagatggggraagtgggctcaggaggtctggatctgtgatgagatggggaaagtgggctcaggaggtctggatctgtgatgagatgggggaagtgggctcaggaggtctggatctgkgrtggrgatctggagtggaagkggarytcakkwgktcwkkrtctrtccttttgtattgattgaattttttatatatatatgtgaattttcacaataaaatttttttccaaaataaaataaacaaaaggggctttttgcaacccaattcctatct

SEQ ID NO: 2681 - DNA, 647 bp, Homo sapiens
  misc_feature (1)...(647): n = A,T,C or G
cacaggcccttttgtgatgcgttccacgtgtaggagatgtggtggccgcggctccatcatcatatcgccctgtgtggtctgcaggggagcaggacaagccaagcagaaaaagcgagtgatgatccctgtgcctgcaggagtcgaggatggccagaccgtgaggatgcctgtgggaaaaagggaaattttcattacgttcagggtgcagaaaagccctgtgttccggagggacggcgcagacatccactccgacctctttatttctatagcycaaggctcttcttgggggaacwgmcwsmgtcccagrgcctgtacgagacgatcaacgtgacgatcccccctgggactcagacagaccagaagattcggatgggtgggaaaggcatcccccggattaacagctacggctacgagaccactacatccacatcaagatacgagttccaaagaggctaacgagccggcagcagarcctgatcctgagctacgccgaggacgagacagatgtggaggggacggtgaacggcgtcaccctcaccagctctggaaaaagatccactggaaactaggccgggaagcagcagcccctccaagggncagggcacctgngacgacgngaggnttccagancagcagcactgagctcc

SEQ ID NO: 2682 - DNA, 870 bp, Homo sapiens
aattccgttgctgtcgccaggaccctggggaaaggaagccagcccccagggccagtcccggaggggctgatccgcatctacagcatgaggttctgcccctattctcacaggacccgcctcgtcctcaaggccaaagacatcagacatgaagtggtcaacattaacctgagaaacaagcctgaatggtactatacaaagcacccttttggccacattcctgtcctggagaccagccaatgtcaactgatctatgaatctgttattgcttattcktgagtaycwgrayrmyrcytatcywkgraggaagctgtttcmatatgacccttatgaacgagctcgccaaaagatgttattggagctatttkgtaaggtcccacattkgacccaaggagtgcctrgtagcgttgaagatgtgggagagaatgcactaatctgaaggcagccctgcgtcaggaattcagcaacctggaagagattcttgagtatcagaacaccaccttctttggtggaacctgtatatccatgattgattacctcctctggccctggtttgagcggctggatgtgtatgggatactggactgtgtgagccacacgccagcctgcggctctggatatcagccatgaagtgggaccccacagtctgtgctcttctcatggataagagcattttccagggcttcttgaatctctattttcagaacaaccctaatgcctttgactttgggctgtgctgagtctcactgtccaccccttcgctgtccagaattccccagcttgttgggagtctacgtcacggcttgtcttgggaaccaatccgtctctctttcttttctttgaagttcccaataaaatgaaaacaggaaatgt

SEQ ID NO: 2683 - DNA, 300 bp, Homo sapiens; identical to SEQ ID NO: 1233

SEQ ID NO: 2684 - DNA, 2672 bp, Homo sapiens
  misc_feature (1)...(2672): n = A,T,C or G
aaaagaaaacgagaccaagtaataaagcagaaggaagaagaagcacagaagaagaaatctgacttggaaatagagctattaaaacggcagcagaagttggagcagcttgaacttgagaagcagaaattgcaagaagagcaagaaaatgcccccgagtttgtgaaggtgaaaggcaatctcaggagaacaggccaagaagtcgcccaagcccaggagtcctaggctgaggctgcaccaagacctcgtgtgtcaccccacagagctgtctgtgggtgccttctcaatctcagggcaaaagcccctggagaatatttcagccagcagagaattttgacttgcagtaggatttggtttgattttcctacgatctgggtggatgccttgcctgtgacagttgcagttcctattcgccaaatgaagggcagtgccccgcacgtaaagttggaatgatggacctgtgttcagagacttaacagaaccaacaagcaaaacaagtgagaacaggaaaaaggaagaggacactggaatcaattcttgagagttgcactacttggtttttcttccattccaagtttcgtgggacccagagccttttttcttttaaaagctaaaaaacaagtgtttaattcctctttttgttatctgttagataattgagatcacctagaaatgcgtttaatctgttcactcactgtaaattttgaggacccagaattgtcttgtttaatttatactttcacccctgttgcagttaacaccagagaaggaacgtgaatgtcgagcacagccactacccttgttggcacttaatttagaaatagggtgagaagtttaaaagcccatcttgattttattttcattccttttggttctctgtgtaataatagcaggctacatagtgacattccagttccaagaaggtacatcctgtccattcattaattgctttgattactaggagggtttctgttcagttttgtttttaaatgtcttgctgatctagttctwtcagatggaataaccttccagtcccttagagagtggaactagtccatataacccagcttcagtagcaaaagtagaagccgccacatcttttcatttctccaagaggagagtggggaaggttcccatgaccagctgggcagtcaggatttctctaggcattctaatgtgaaataagtgtagactgctgtcaaggaggcttcatcagaagatgtatagcatttgaatgtctaatgataatgcatatcattagaatccaagctttgaaaatttctgattaatgctcatgtatttctttatctttgtttttccttgtgaagaaagactttcaccactgtctgagtgatgatgctgttgataaggatgatgtcgatgactactatattgcatctctcaggaacagctgatgggaagggaggggctgctgagttcccttgttctagctagcagcacgctcctcagagagggggccgagttacagacagcagccgcattctcatgcaaaattagttttaaactgctagtgtgggcatcggtaccttttgcctgggtgataccgaagaattgttgaggatttagtatgctccgtagagacagttcagccagtcatttctgcattggagagacttctcatactttctttgaagactcatagaaagctggatctagagcttttgaatccttaattagcacagtagaaattagctttctatgggaatgctttagtgttagcagttgacaattaggcccatattcaatctgaatgggaacaaaagtaaatgcaatgataatatactgctagttagagaaacatgttagttgattatacctgaaatggattatttatctcatcagcaagtattatttgaataaaatgagaaatgcttaagaaaaattgttgctctatagtaatttggtttcgaagaatggaatggtaactattttttcccatcgttcttttgagagaaggaagtgtgatgactgatgatcttgaaaagcccatttctgattgcacgttgactggaattctttctttgtgtctgtggactagcgatgctgtttgtaaaatgaagattcgggactggctcatatctttttatctaactagatgtcagatcttgaaatctgtattctcgaagcaattctgccacttgatcgtattcacaggggccctggtaggctcctttagaaggaccatttctgttcctagagcttaactagaattcattcttcactgaaaaaaaaaaaagttacttaagaaagcatttctttcctaatctcactcaaatctgcagaattatttgtaattagtaatacaaaatctggccaaaaggagacttgtaaatagcgtaaagtggtgtcttatgctaaacggtggaatgtataggcagagaagctctttgaagttgtcagatgagctgggctcacaagcctgattcaaacaggctgkcggtctcctctcaccccttaatactgtkgcaagccccaaactccctaggactccttgaacatctttgagcagtttttggtgcctttgaggccacctttttggnccaaaaatgggctcccatttttccacagcggggggttttcccttaaaatnggtttaaagggttttaanaggccccntaggnaggaagnggttggccttccttaaggccaaaaaa

SEQ ID NO: 2685 - DNA, 1282 bp, Homo sapiens
aattccgttgctgtcggtggttgacgagctcggcggcggttttgctgagatctgtggccgtcggcagctggtgcggggggcagctgagagcgagaggtggatcggggcggtgtgtggccagggcmrtgacgggcaatgcsgkggagtggtgcctcatggaaagcgaccccggggtcttcaccgagctcattaaaggattcggttgccgaggagcccaagtagaagaaatatggagtttagagcctgagaattttgaaaaattaaagccagttcatgggttaatttttcttttcaagtggcagccaggagaagaaccagcaggctctgtggttcaggactcccgacttgacacgatattttttgctaagcaggtaattaataatgcttgtgctactcaagccatagtgagtgtgttactgaactgtacccaccaggatgtccatttaggcgagacattatcagagtttaaagaattttcacaaagttttgatgcagctatgaaaggcttggcactgagcaattcagatgtgattcgacaagtacacaacagtttcgccagacagcaaatgtttgaatttgatacgaagacatcagcaaaagaagaagatgcttttcactttgtcagttatgttcctgttaatgggagactgtatgaattagatggattaagagaaggaccgattgatttaggtgcatgcaatcaagatgattggttcagtgcagtaaggcctgtcatagaaaaaaggrtacaaaagtacagtgaaggtgaaattcgatttaatttaatggccattgtgtctgacagaaaaatgatatatgagcagaagatagcagagttacaaagacaacttgcagaggaacccatggatacagatcaaggtaatagtatgttaagtgctattcagtcagaagttgccaaaaatcagatgcttattgaagaagaagtacagaaattaaaaagatacaagattgagaatatcagaaggaagcataattatctgcctttcattatggaattgttaaagactttagcagaacaccagcagttaataccactagtagaaaagggaaaataggataaaagaacaaggtgtgagaaggaatagaaggaaacaaacaggaaagatatggctgcaccatgcagtgctactatatgctgagattctacaggatgagatttttgaatagctgagcagttgcctataatctgtgatgacataaaagtatttgacctaaaatctttttatttgcaaaataataaataaaaagtgattctccctcg

SEQ ID NO: 2686 - DNA, 681 bp, Homo sapiens
  misc_feature (1)...(681): n = A,T,C or G
gcggctcttttccctcgtgactcggttgctcctggcgccgcgacggggcctcacggtccgcagtcccgacgaacccctgccggtggtgcgcattccagaagagctcccgagacatacttctctgcacagacatagcctctcggggcctggaccagcactggtgtggagctggttgtcaattatgatttccccccaacgctgcaagattacatccacagagcagggagagtgggccgtgtggggagcgargtgccaggcaccgtcatcagttttgtgacccatccctgggatgtgagcctggttcagaagattgagcctggcggctcgccgaaggaraagtcttccnaggactagcatcctcggtgaaagagcctttgccccaagcaacctgattttgacaaatctgattaaaatgtgatgctagaacagggatctttcccagtatcttgagtgggtgacccacacttgtcagtgggaggctctgggctgcctgtcggctccttgagggcgggatgaactgctttgtgacttggaaaggtacgctgctggccagcattggagaagaagctgctgagcatggctttctgtagtctttagcaagacacaagtggattttgactttgtatcatgtcatgatttctaacaataaatgatgtttttatgtgcaaaaaaaaaaaaaaa

SEQ ID NO: 2687 - DNA, 300 bp, Homo sapiens; identical to SEQ ID NO: 1259

SEQ ID NO: 2688 - DNA, 964 bp, Homo sapiens
aattccgttgctgtcgctgaaggtcatcaggcagtctgctgggcaaaagacaacctgtggccagggtctggaagggccctgggagcgcccaccccctctggatgagtccgagagagatggaggctctgaggaccaagtggaagacccagcactaagtgagcctggggaggaacctcagcgcccttccccctctgagcctggcacataggcacccagcctgcatctcccaggaggaagtggaggggacatcgctgttccccagaaacccactctatcctcaccctgttttgtgctcttcccctcgcctgctagggctgcggcttctgacttctagaagactaaggctggtctgtgtttgcttgtttgcccacctttggctgatacccagagaacctgggcacttgctgcctgatgcccacccctgccagtcattcctccattcacccagcggaggtgggatgtgagacagcccacattggaaaatccagaaaaccgggaacagggatttgcccttcacaattctactccccagatcctctyccctggrcacaggagacccacagggcaggaccctaagatctggggaaaggaggtcctgagaaccttgaggtacccttagatccttttctacccactttcctatggaggattccaagtcaccacttctctcaccggcttctaccagggtccaggactaaggcgtttttctccatagcctcaacattttgggaatcttcccttaatcacccttgctcctcctgggtgcctggaagatggactggcagagacctctttgttgcgttttgtgctttgatgccaggaatgccgcctagtttatgtccccggtggggcacacagcggggggcgccaggttttccttgtcccccagctgctctgcccctttccccttcttccctgactccaggcctgaacccctcccgtgctgtaataaatctttgtaaat

SEQ ID NO: 2689 - DNA, 635 bp, Homo sapiens
ccgcactatagaatacaagctacttgttctttttgcaggatcccatcgagaaaaaactggccatgcagaagtcgtccgagtggtgtaccagccagaacacatgagttttgaggaactgctcaaggtcttctgggagaatcacgacccgacccaaggtatgcgccaggggaacgacccatggcactcagtaccgctcggccatctacccgacctctgccaagcaaatggaggcagccctgagctccaaagagaactaccaaaaggttctttcagagcacggcttcggccccatcactaccgacatccgggagggacagactttctactatgcggaagactaccaccagcagtacctgagcaagaaccccaatggctactgcggccttgggggcaccggcgtgtcctgcccagtgggtattaaaaartaattgctccccacatggygggcctttgaggttccagtaaaaatgctttcaacaaatgggcaatgcttgtgtgattcacaatcgtggcatttaaagtgcacaagtacaaggaatttatacagattggkttaccgmagtataatctataggaggcgcgatggcagtgataaatgtgacttatctcctaataagtatggggggtggagctgt

SEQ ID NO: 2690 - DNA, 300 bp, Homo sapiens; identical to SEQ ID NO: 516

SEQ ID NO: 2691 - DNA, 300 bp, Homo sapiens; identical to SEQ ID NO: 517
  misc_feature (1)...(300): n = A,T,C or G

SEQ ID NO: 2692 - DNA, 676 bp, Homo sapiens
  misc_feature (1)...(676): n = A,T,C or G
cttgaatcccttgaccttactgatgagaaaaaggtcctcgagtgggctcaggagaagcgtaagctgagcgtgttgcatattcacggagtctacaccaaccctagtggcattgtccttcatccggctggatatcagaacgtgctcaggaacactgaagtcatgagagaaattcagaaactctacgaaaacaagtcatttcttttcctgggctgtggctggactgtggatgacaccactttccaggcccttttcttggaggctgtcaagcataaatctgacctagaacatttcatgctggttcggagaggagacgtagatgagttcaaaaagcttcgagaaaacatgctggacaaggggattaaagtcatctcctatggagatgactatgccgatcttccagaatatttcaagcgactgacatgtgagatctccacaaggggtacatcagggatggtgagagaaggtcagctaaatggctcatctgcagcacacagtgaaataagaggctgtagtacatgagcgagctagagaaatcaccaccgtttangaccaagctgtaaggccctactacagacagtgtttaacaagtaaactttacaagaacccaacacaattccccagaaagtnaccaatagccngaggttgnagggnccggggttgaacaacggggggnatg

SEQ ID NO: 2693 - DNA, 829 bp, Homo sapiens
  misc_feature (1)...(829): n = A,T,C or G
aattccgttgctgtcgcttacttctcacacccagccatccgctatcaccctcaggagacgctgaaagaatttgtccaacttgtctgccctgatgctggtcagcaggctggacaggtggggttcctcaatcccaatgggagcagccaaggcaaggtgcacaacccattccttcccaccccaatgttgccaccgccaccgccaccaccgatggccaggcctgtgcctctgccggtgccagacacaaagcctccaaccacgtcaacagaaggaggtgcagcctcccccacgtcaccaatcctrctcgacacccagcacctcccccgcaaaccgattcgtcagtgttggaccacgggatccaagctttgtaaatatccctcaacagacacagtcctggtacctgggataaaagttgcagcgtcccaccatccaccagacagaccacctgaycccttctcaactctgtaacatggacgcaacctcaacccagcgcagttacaacttcactatcagcggaaggggagaaaaaccgattcaaatcaacttgtacatggaaacagcaagcattatggtcaaacagcaaaggccataaccttttgggatttttttttttttaaaatactttagggactgttgtaatttctcatatggtgctggaaatggttgggctttgtaacatttgaagtgtttccatggtarcgtgamatttaggttgacgtggctaagccggagggactaacccttgctcactgacttcctgttgtaaacactttccttamggggcctgggctgttttcacagtaatttcnatgaaatttaccccacacaggtg

SEQ ID NO: 2694 - DNA, 396 bp, Homo sapiens
  misc_feature (1)...(396): n = A,T,C or G
cggatatcctctccctcatcaaacttttctccaccaactttagcatctggttgccaccctccaaaatggccccagtgatcccatctcctaataagtacatgtctgtgtggtcctctccyacactgcataggaatggcttacgtaaccaataggtagttgaggatgtgatgcagtctgacttttgaggctaagttgtaaagaaagacactgtgtctttcctccttgttgtcttggagcgcttgctctnggagaaagccagaggttcatgttcgtgagggataacttcaagttgnccatttgggagaggtgnacattgggtgaaggaaatgaaggncctaactggccaattgnacccatgttaaagttnagtccaaccaagggnagattatttaccca

SEQ ID NO: 2695 - DNA, 467 bp, Homo sapiens
  misc_feature (1)...(467): n = A,T,C or G
ggcttctgcaaccaggaccggaggacactcccgggggggcagcctcccccccgggtgtttctggccgtgtttgtggaacagcctactccgtttctgccccgcttcctgcagcggctgctactcctggactatccccccgacagggtcacccttttcctgcacaacaacgaggtcttccatgaaccccacatcgctgactcctggccgcagctccaggaccacttctcagctgtgaagctcgtggggccggaggaggctctgagcccaggcgaggccagggacatggccatggacctgtgtcggcaggaccccgagtgtgagttctacttcagcctggacgccgacgctgtcctcaccaacctgcagaccctgcgtatcctcattgaggagaacaggaaggtgatcgnccccatgctgtnccgncacggnaagcttgtggtccaacttctgggggcgccctgagcccc

SEQ ID NO: 2696 - DNA, 706 bp, Homo sapiens
gtcggctcttcctatcattgtgaagcagaattcaccaagcgttggattgttcacccactaatagggaacgagagccgaacagctgaagagagttcactgactccccagccccaggtgggccttgtgcacatcatgaccagttttgaagatgctgacacagaagagacagtaacttgtctccagatgacggtttaccatcctggccagttgcagtgtggaatatttcagtcaataagttttaacagagagaaactcccttccagcgaagtggtgaaatttggccgaaattccaacatctgtcattatacttttcaggacaaacaggtttcccgagttcagttttctctgcagctgtttaaaaaattcaacagctcagttctctcctttgaaataaaaaatatgagtaaaaagaccaatctgatcgtggacagcagagagctgggctacctaaataaaatggacctgccatacaggtgcatggtcagattcggagagtatcagtttctgatggagaaggaagatggcgagtcattggaattttttgagactcaatttattttatctccaagatcactcttgcaagaaaacaactggccaccacacagrcccataccggagtatggcacttaytcgctctgctcctcccaaagcagttctccgacagaaatgggatgaaaatgagtcatggacacagaaagtctaaagg

SEQ ID NO: 2697 - DNA, 566 bp, Homo sapiens
cagctcctccaccagcataatgggacccagcatccctgccaaaactcgggaggtgctcgtcagccacctggcatcttacaacacatgggctttacaaggcatgtatggagtttcttgtgggcttsgsaggtgsyygtsaaggccaycwgygatctkaagccwryacwtgsscytymcmaggtcctgtgagtggagaggcacagagtgttctgggctagctgagtgtggaggctgggtggctctgatgctagccaatcactctacgctctaggctcacacctttccacctycgacttcgccagcagaagtcttgagttcaatctcattgccctggcttgggtcacatgtccatccatgaaccaatcactagactgggtgcggaaactctgatttgccaagttcgggtcatgtgtctcactaggtaagagcagaggaggatcacccccaggaagaccagagtgctctttcagaagagtgggacaatcgctggatggctctttgcaccactcactcctgttctctgctagggctgctgggactcacaaggggtaggttgtggcagctgc

SEQ ID NO: 2698 - DNA, 760 bp, Homo sapiens
  misc_feature (1)...(760): n = A,T,C or G
ttgaaattacaaatcacgcaactgcaacactagaaggcaatcagatttttaacaaccggtttggaggcttatttttagcatctggtgttaatgtgacaatgaaagataacaaaataatgaacaatcaagatgccatagaaaaggctgttagtagaggccaatgtttatataaaatatcaagttataccagctatcccatgcatgatttctacagatgtcatacttgtaacaccacagatcgaaatgccatatgtgtgaactgcattaagaagtgccatcagggacatgatgtagagtttattagacatgataggtttttctgtgactgtggtgctggaacactgtctaatccttgtacattagctggtgagctacacatgatacagatacactatatgactctgctccacctatagaatstaatacattgcagcacaactgaattccttccctaaagaaaaagtccctgcccattggtaacatccataactttaaaacactttttttggaagaagatttaaaatattttggcccatggctacagggaagagactggtattaaaaatgggatacaccaggtcagttgacacctatggaagcctccaagctacccaaaaaggaaagtggggcnatatattggactccngggatctccnaagcctggggtggntttaggcattaccggggggtaaagacctttgaaggggccagaagttggaggaaataagccggccattttggtncggatcccaccttctgg

SEQ ID NO: 2699 - DNA, 273 bp, Homo sapiens; identical to SEQ ID NO: 651
  misc_feature (1)...(273): n = A,T,C or G

SEQ ID NO: 2700 - DNA, 334 bp, Homo sapiens
gttaacaagcgtcatgaacaggatgcacgtggtcagcgtcccctacgcgctgatgaaggcgaacccactctcctggatccagaaagtgtgcttctataaagctcgggccgcgctggtgaagtcgcgagacatgcactggtctctcctagctcagcggggccagagggacgtcagcctcagctcactgcgcatgctgattgtggccgatggtgccaacccgtggtcgatctcctcctgtgacgccttcctcaacgtcttccagtccagaggtctgaggccagaggtcatctgtccttgtgcaagttctcctgaggcgctgacttgtcggcatccg

SEQ ID NO: 2701 - DNA, 306 bp, Homo sapiens
ggtagaagcagcaaagaaagcccaccatgcagcgtgcaaagaggagaagctggctatckcrcrwgaagccaacagcaaggcagacccatccytcaaccctkaacagctcaagaaattgcaagacaaaatagaaaagtgcaagcaagatgttcttaagaccaaagagaagtatgagaagtccctsaaggaactcgaccagggcacaccccagtacatggagaacatggagcaggtgtttgagcagtgccagcagttcgaggagaracgccttcgcttyttccgggaggttctgcttggaggttcaag

SEQ ID NO: 2702 - DNA, 1078 bp, Homo sapiens
ggtgaatgccacacccttcaagattgctcgaggccagatcttgaagatactcacagggaagatagtggtggggcatgccatccacaacgacttcaaagcccttcagtactttcaccccaagtccctcacccgtgacacctcccatmkscmcsmsctcaaccggaaggctgactgcccggagaatgccaccatgtctctgaagcatctcaccaagaagctgctaaaccgggatatccaggttgggaagagcggacattcctctgtggaagatgcccaggccaccatggagctatataagttggttgaagtcgagtgggaagagcacctagcccggaatccccctacagactagtggcartggggacgctggtgatatgaggaggcagaggcagcacccaggagaaacagggcagtggaccaatggacagctccaccagctccacatctttggaagctagatttggggagagagaagctctaccccagacttaatacccattgaaatttcacctcaggtgttgtgtcctgtgtctggttaagtgtcccatggaaggggaaagccttcacgtcagaacccaaccctataccttttacttcttaaatggtgctaacacaggtgtcccagggtgctctgtgccagttaagatttttaactttcaaggggcagggcatactgggaaatgtagtttcccaaactgccttatcacttgggtggacatatgtctccttttatgccttttggtcttgagtaattaacagcatcctcttccacgctcagaagtgttctggttggggccaggcatggtggctcacgcctgtagtcccaacacttagggaggccgaggcgggcggatcacctgagatcaggagttcaagaccagcctggccaacatggcgaattcccgttctctactaaaaatacaaaaaatgtgtggggtgtggtggcaggagcctgtaatcctagctactcaggaggctgaggcaggagaatcgcttgagcccaggaggcggagattgcagtgagccgagatcgtgtcactgcactccagcctgggtgacaagagtgagatccgtctcc

SEQ ID NO: 2703 - DNA, 300 bp, Homo sapiens; identical to SEQ ID NO: 726
  misc_feature (1)...(300): n = A,T,C or G

SEQ ID NO: 2704 - DNA, 441 bp, Homo sapiens
  misc_feature (1)...(441): n = A,T,C or G
ccgatacgaggcaaacggggaagttaagcaaagaccaattcgcgttagctatgtatttcattcagcagaaggtcagtaaaggcatcgaccctcctcaagtcctctcgccggacatggtcccgccttcggagagaggcacgcccggcccggacagttcaggctctctcggctccggggagtttactggcgtgaaggagcttgattgacatcagtcaagagattgcccagttacaaagagagaaatattcactggaacaagacattcgagaaaaggaagaggcaatcatgacagaaaaccagcgaggtgcaggaattacaaaatgacctagaccgggaaacaagcagtttncaggagctcgaggctcagaaacaggatgctcaagaccgcctggncgagatngaccagcagaaggccaagctncgagacatgctnagcgacgt

SEQ ID NO: 2705 - DNA, 439 bp, Homo sapiens
  misc_feature (1)...(439): n = A,T,C or G
ccgatacgaggcaaacggggaagttaagcaaagaccaattcgcgttagctatgtatttcattcagcagaaggtcagtaaaggcatcgaccctcctcaagtcctctcgccggacatggtcccgccttcggagagaggcacgcccggcccggacagttcaggctctctcggctccggggagtttactggcgtgaaggagcttgatgacatcagtcaagagattgcccagttacaaagagagaaatattcactggaacaagacattcgagaaaaggaagaggcaatcagacagaaaaccagcgaggtgcaggaattacaaaatgacctagaccgggaaacaagcagtttncaggagctcgaggctcagaaacaggatgctcaagaccgcctggncgagatngaccagcagaaggccaagctncgagacatgctnagcgacgt

SEQ ID NO: 2706 - DNA, 304 bp, Homo sapiens
gggactcgttaccatcactcccaccacaggctccgatgggcgcccagatgcccgggtccgcctcgaccgcagcaagatccggtctgtgggcaagcctgctctagagcgcttcctgcggagacttcaggtgctgaagtccacaggggatgtggccggagggcgggccctgtacgaggggtatgcaacggtcactgatgcgccccccgagtgcttcctcaccctcagggacacggtgctgctgcgtaaggaatctcggaagctcattgttcagcccaacactcrccttgaaggctcagacgtgcag

SEQ ID NO: 2707 - DNA, 921 bp, Homo sapiens
  misc_feature (1)...(921): n = A,T,C or G
gaaattctggtcctcccttccgagcaacgtttgcaacgatgagaggatggctgcaggaaacggcaatgaggatgactgttggaatgggaaaggcaaaagcaggtacctgtttgcagtgacaggaaatggattagccaaccagggcaacaacccagaggtccaggttgacaccagcaaaccagacatactgatccttcgtcaaatcatggctcttcgagtgatgaccagcaagatgaagaatgcatacaatgggaacgacgtggacttctttgatatcagtgatgaaagtagtggagaaggaagtggaagtggctgtgagtatcagcagtgcccttcagagtttgactacaatgccactgaccatgctgggaagagtgccaatgagaaagccgacagtgctggtgtccgtcctggggcacaggcctacctcctcactgtcttctgcatcttgttcctggttatgcagagagagtggaagataattctcaaactctgagaaaaagtgtttcatcaaaaagttaaaaggcaccagttatcacttttctaccatcctagtgactttgctttttaaatgaatggacaacmatgtacagtttttactatgtggcccactggtttaagaagtgctgactttgttntctcattcagttttgggaggaaaagggactgtgcattgagttggttccctgctcccccaaaccatgttaaacgtggctaacagtgtaggtacagaactatagttagttgtgcatttgtgattttatcactctattatttgtttgtatgtttttttctcatttcgtttgtgggtttttttttccaactgtgatctcgccttgtttcttacaagcaaaccagggtcccttcttggcacgtaacatgtacgtatttctgaaatattaaatagctgtacagaaaaan

We claim:

1. An isolated polynucleotide comprising at least 150 contiguous nucleotides of a sequence selected from SEQ ID NO:972 and a complement of SEQ ID:972.

2. A vector comprising a polynucleotide of claim 1.

3. A host cell comprising the vector of claim 2.

4. An isolated polynucleotide comprising at least 200 contiguous nucleotides of SEQ ID NO:972 and which hybridizes under stringent conditions to a polynucleotide of a sequence selected from SEQ ID NO:972 and a complement of SEQ ID:972.

5. An isolated polynucleotide comprising a nucleotide sequence of an insert contained in a clone deposited as clone number M00007118B:B04 of ATCC Deposit Number PTA-60, wherein said isolated polynucleotide comprises at least 1.50 contiguous nucleotides of a sequence selected from SEQ ID NO:972 and a complement of SEQ ID NO:972.

6. An isolated polynucleotide comprising at least 150 contiguous nucleotides of SEQ ID NO:972 obtained by amplifying a fragment of cDNA using at least one polynucleotide primer comprising at least 15 contiguous nucleotides of a nucleotide sequence selected from the group consisting of: SEQ ID NO: 972 and a complement of SEQ ID NO: 972.

7. A vector comprising a polynucleotide of claim 6.

8. A host cell comprising the vector of claim 7.

* * * * *